US009587036B2

(12) United States Patent
Kufer et al.

(10) Patent No.: US 9,587,036 B2
(45) Date of Patent: *Mar. 7, 2017

(54) CROSS-SPECIES-SPECIFIC PSMAXCD3 BISPECIFIC SINGLE CHAIN ANTIBODY

(75) Inventors: Peter Kufer, Münich (DE); Ralf Lutterbuese, Munich (DE); Matthias Klinger, Munich (DE); Petra Fluhr, Munich (DE); Doris Rau, Munich (DE); Susanne Hausmann, Munich (DE); Carola Steiger, Munich (DE); Tobias Raum, Munich (DE); Patrick Hoffmann, Munich (DE); Roman Kischel, Munich (DE); Evelyne Schaller, Munich (DE); Susanne Mangold, Munich (DE)

(73) Assignee: AMGEN RESEARCH (MUNICH) GMBH, Munich (DE)

(*) Notice: Subject to any disclaimer, the term of this patent is extended or adjusted under 35 U.S.C. 154(b) by 41 days.

This patent is subject to a terminal disclaimer.

(21) Appl. No.: 13/638,223

(22) PCT Filed: Apr. 1, 2011

(86) PCT No.: PCT/EP2011/055104
§ 371 (c)(1),
(2), (4) Date: Jan. 17, 2013

(87) PCT Pub. No.: WO2011/121110
PCT Pub. Date: Oct. 6, 2011

(65) Prior Publication Data
US 2013/0129730 A1    May 23, 2013

Related U.S. Application Data

(60) Provisional application No. 61/320,052, filed on Apr. 1, 2010.

(51) Int. Cl.
*C07K 16/46* (2006.01)
*A61K 39/395* (2006.01)
*C07K 16/28* (2006.01)
*C07K 16/30* (2006.01)

(52) U.S. Cl.
CPC ......... *C07K 16/468* (2013.01); *C07K 16/2809* (2013.01); *C07K 16/30* (2013.01); *C07K 16/3069* (2013.01); *C07K 2317/31* (2013.01); *C07K 2317/33* (2013.01); *C07K 2317/622* (2013.01)

(58) Field of Classification Search
None
See application file for complete search history.

(56) References Cited

U.S. PATENT DOCUMENTS

2009/0041789 A1* 2/2009 Elsaesser-Beile et al. .................. 424/178.1
2011/0262439 A1* 10/2011 Kufer .................. C07K 16/2809 424/135.1
2011/0275787 A1* 11/2011 Kufer et al. .................. 530/324
2012/0034228 A1* 2/2012 Kufer et al. .................. 424/135.1

FOREIGN PATENT DOCUMENTS

| CN | 101675077 A | 3/2010 |
|---|---|---|
| JP | 2008-541711 A | 11/2008 |
| JP | 2009-511521 A | 3/2009 |
| JP | 2011-529563 A | 12/2011 |
| WO | WO-2006/089230 A2 | 8/2006 |
| WO | WO-2006/125481 A1 | 11/2006 |
| WO | WO 2007/042261 A2 | 4/2007 |
| WO | WO 2008/119565 A2 | 10/2008 |
| WO | WO 2008/119566 A2 | 10/2008 |
| WO | WO 2008119567 A2 * | 10/2008 |
| WO | WO-2010/037835 A2 | 4/2010 |
| WO | WO-2010/037836 A2 | 4/2010 |
| WO | WO-2010/037837 A2 | 4/2010 |

OTHER PUBLICATIONS

Rudikoff et al. (Proceedings of the National Academy of Sciences, 1982, 79:1979-1983).*
MacCallum et al. (Journal of Molecular Biology, 1996, 262:732-745).*
De Pascalis et al. (Journal of Immunology, 2002, 169:3076-3084).*
Casset et al. (Biochemical and Biophysical Research Communications, 2003, 307:198-205).*
Vajdos et al. (Journal of Molecular Biology, 2002, 320:415-428).*
Holm et al. (Molecular Immunology, 2007:1075-1084).*
Chen et al. (Journal of Molecular Biology, 1999, 293:865-881).*
International Search Report received in the corresponding application PCT/EP2011/055104, dated Jul. 8, 2011.
Amann et al., Antitumor activity of an EpCAM/CD3-bispecific BiTE antibody during long-term treatment of mice in the absence of T-cell anergy and sustained cytokine release. *J. Immunother.* 32(5): 452-64 (2009).
Anonymous, Phase II study of the BiTE TM Blinatumomab (MT103) in patients with minimal residual disease of B-precursor acute ALL, <<http://clinicaltrials.gov/archive/NCTO0560794/2008_08_11>> [retrieved Mar. 10, 2010].
Buehler et al., A bispecific diabody directed against prostate-specific membrane antigen and CD3 induces T-cell mediated lysis of prostate cancer cells. *Cancer Immunol.* 57(1): 43-52 (2007).
Buehler et al., Target-dependent T-cell activation by coligation with a PSMA x CD3 diabody induces lysis of prostate cancer cells. J. Immunother. 32(6): 565-73 (2009).

(Continued)

*Primary Examiner* — Julie Wu
(74) *Attorney, Agent, or Firm* — Marshall, Gerstein & Borun LLP

(57) ABSTRACT

The present invention relates to a bispecific single chain antibody molecule comprising a first binding domain capable of binding to an epitope of human and non-chimpanzee primate CD3 epsilon chain, wherein the epitope is part of an amino acid sequence comprised in the group consisting of SEQ ID NOs. 2, 4, 6, and 8, and a second binding domain capable of binding to prostate-specific membrane antigen (PSMA). The invention also provides nucleic acids encoding said bispecific single chain antibody molecule as well as vectors and host cells and a process for its production. The invention further relates to pharmaceutical compositions comprising said bispecific single chain antibody molecule and medical uses of said bispecific single chain antibody molecule.

34 Claims, 7 Drawing Sheets

(56) References Cited

OTHER PUBLICATIONS

D'Argouges et al., Combination of rituximab with blinatumomab (MT103/MEDI-538), a T cell-engaging CD19-/CD3-bispecific antibody, for highly efficient lysis of human B lymphoma cells. *Leukemia Res.* 33(3): 465-73 (2009).

Fortmueller et al., Effective targeting of prostate cancer by lymphocytes redirected by a PSMA * CD3 bispecific single-chain diabody. *Prostate* 71(6): 588-96 (2010).

Katzenwadel et al., Construction and in vivo evaluation of an anti-PSA x anti-CD3 bispecific antibody for the immunotherapy of prostate cancer. *Anticancer Res.* 20(3A): 1551-6 (2000).

Lutterbuese et al., Preclinical characterization of MT112/BAY 2010112, a novel PSMA/CD3-bispecific BiTE antibody for the treatment of prostate cancer. <<www.micromet.com/Assets/AACR2011-PSMA-Poster.aspx>> [retrieved Jul. 5, 2011].

Molhoj et al., CD19-/CD3-bispecific antibody of the BiTE class is far superior to tandem diabody with respect to redirected tumor cell lysis. *Molec. Immunol.* 44(8): 1945-53 (2006).

Schlereth et al., 224 poster characterization of a murine EpCAM/CD3-bispecific BiTE molecule as a surrogate for preclinical development of the human EpCAM/CD3-bispecific BiTE molecule MT110. *Eur. J. Cancer Suppl.* 4(12): 70 (2006).

Sebastian et al., Treatment of malignant pleural effusion with the trifunctional antibody catumaxomab (removab) (Anti-EpCAM x Anti-CD3) results of a phase 1/2 study. *J. Immunother.* 32(2): 195-202 (2009).

GenBank Accession No. EHH56646.1, Yan et al., Glutamate carboxypeptidase 2 [Macaca fascicularis], dated Nov. 4, 2011.

GenBank Accession No. NP_004467, Naushad et al., Folate hydrolase 1 isoform [*Homo sapiens*], dated Feb. 7, 2010.

Kipriyanov et al., Bispecific CD3 x CD19 diabody for T cell-mediated lysis of malignant human B cells. *Int J. Cancer* 77: 763-72 (1998).

* cited by examiner

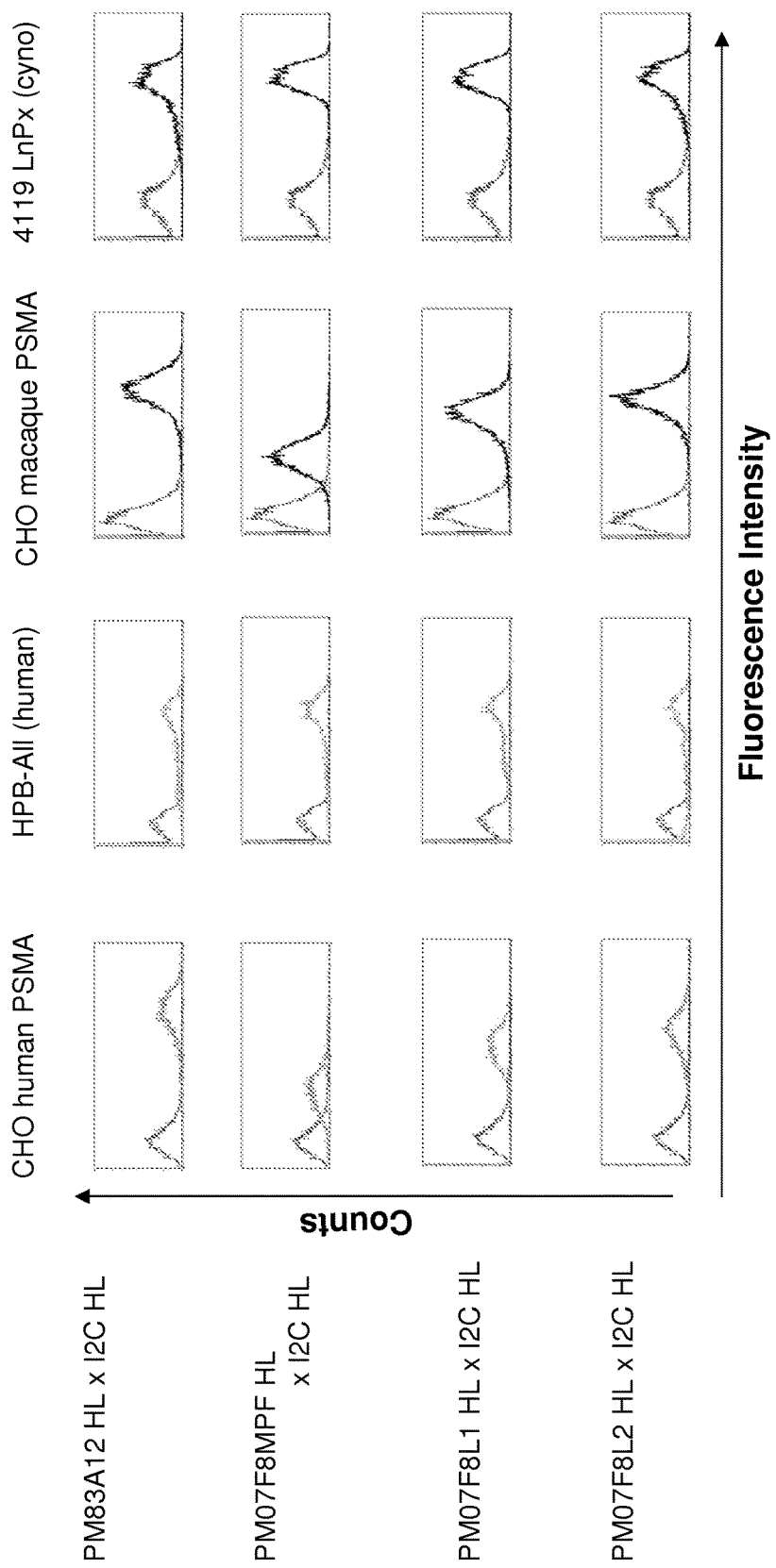
Figure 1(1): PSMA 76-B10 Derivatives

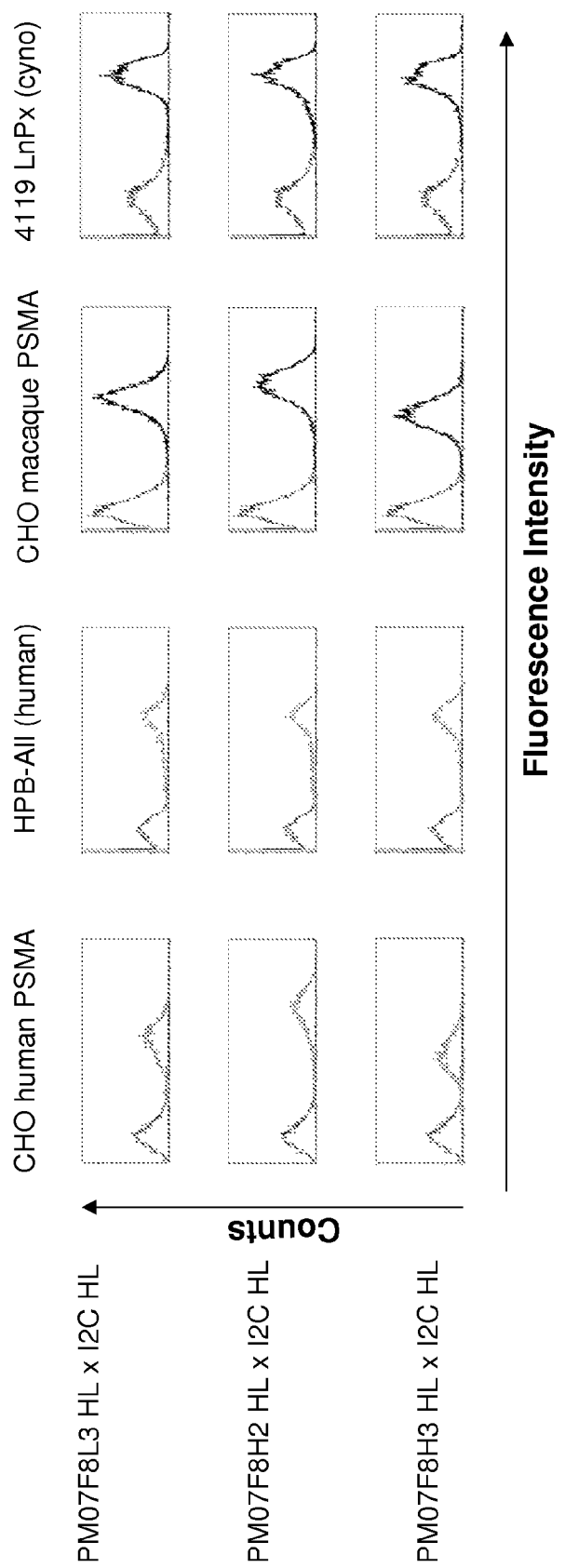
Figure 1(2): PSMA 76-B10 Derivatives

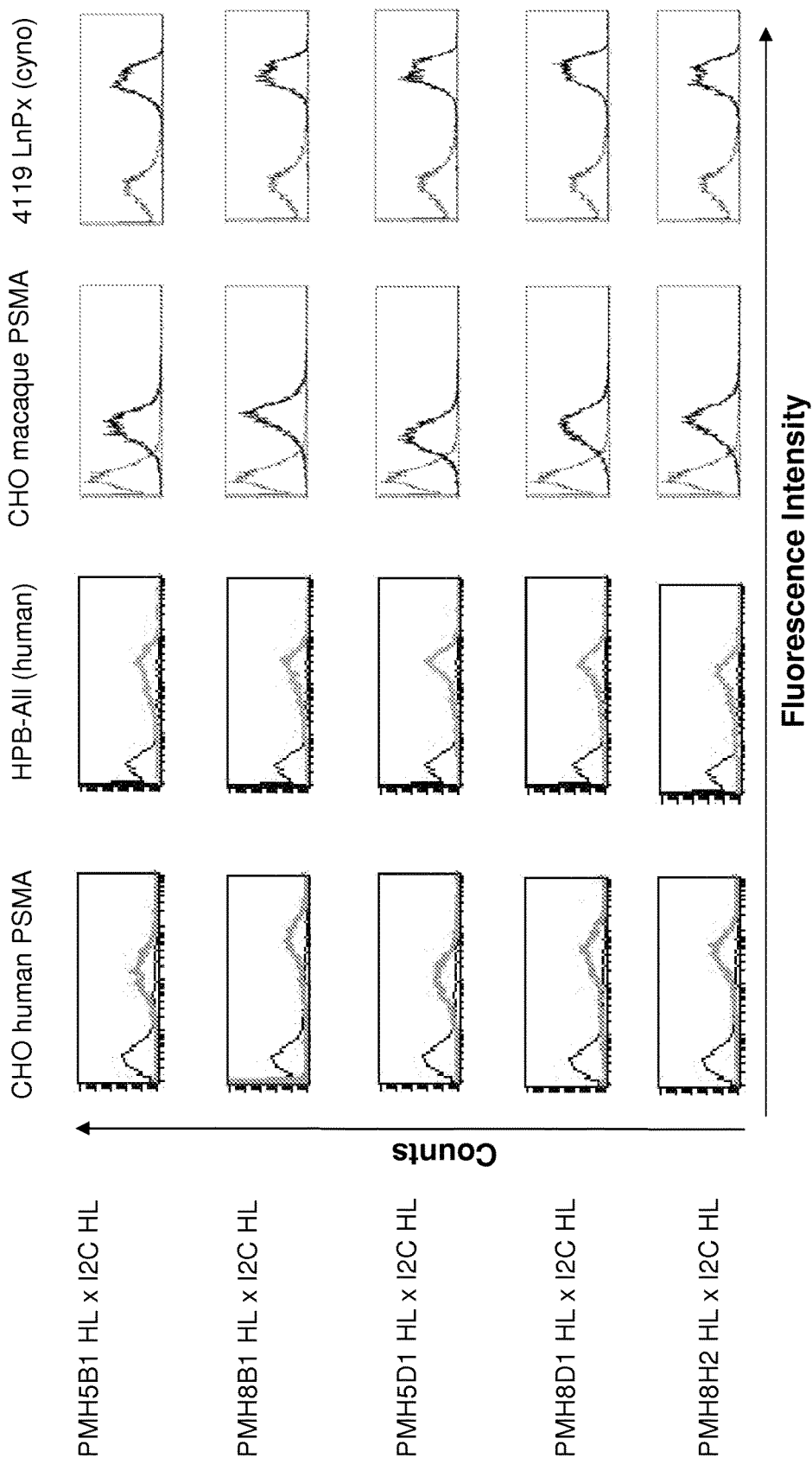

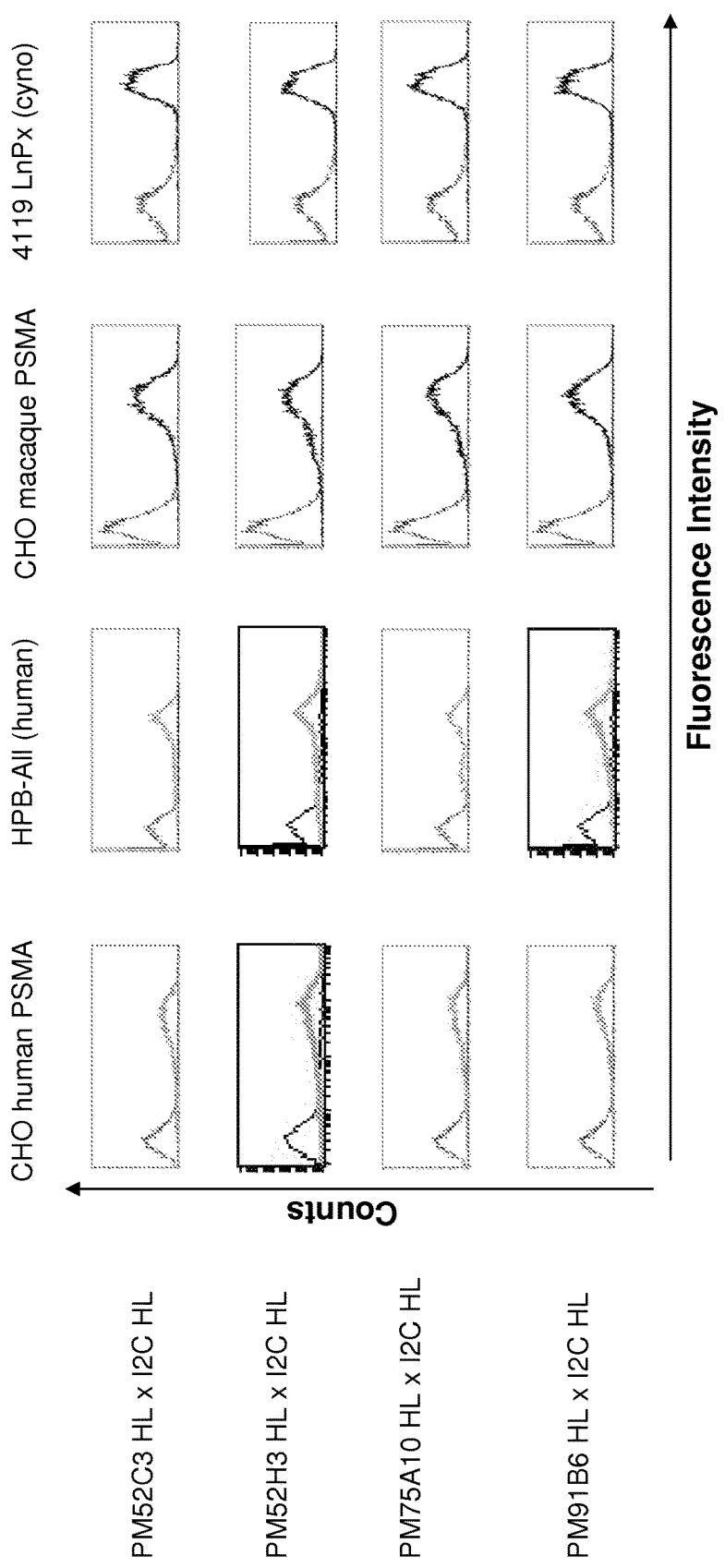
Figure 1(4): PSMA 29-G1 Derivatives

Figure 2(1): PSMA specific BiTEs
A) Effector cells: human stimulated T cells
   Target cells: CHO transfected with human PSMA
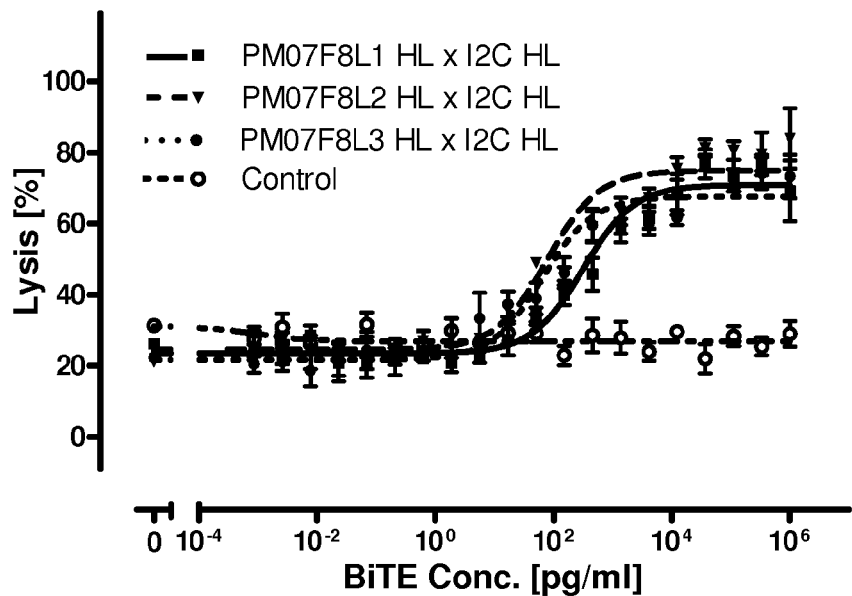
B) Effector cells: human stimulated T cells
   Target cells: CHO transfected with human PSMA
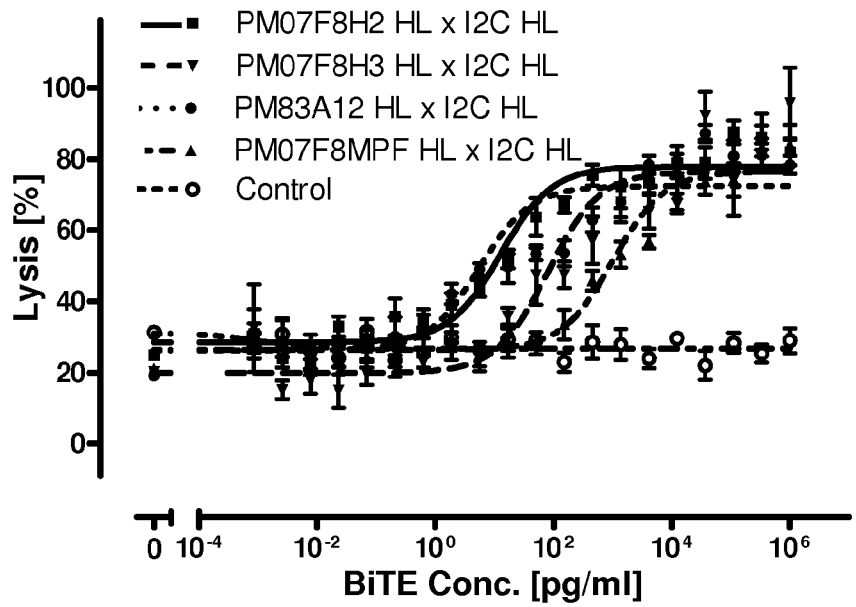

Figure 2(2): PSMA specific BiTEs
C)  Effector cells: human stimulated T cells
    Target cells: CHO transfected with human PSMA
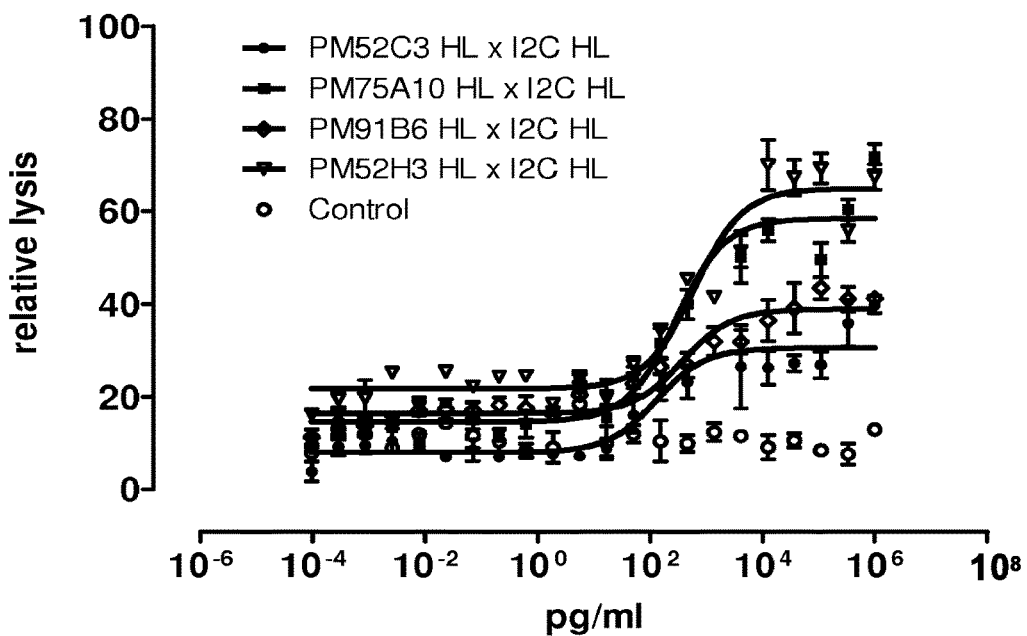
D)  Effector cells: human stimulated T cells
    Target cells: CHO transfected with human PSMA
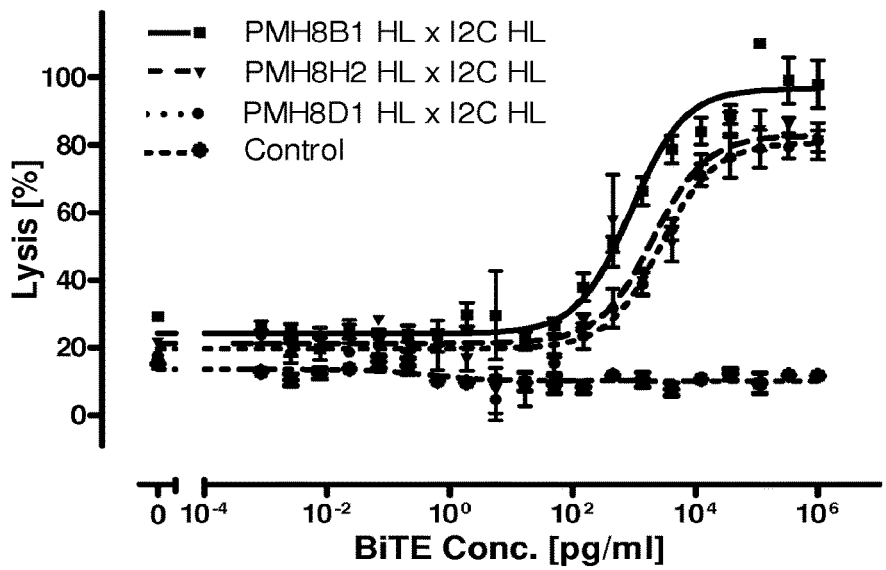

Figure 2(3): PSMA specific BiTEs
E) Effector cells: human stimulated T cells
Target cells: CHO transfected with human PSMA
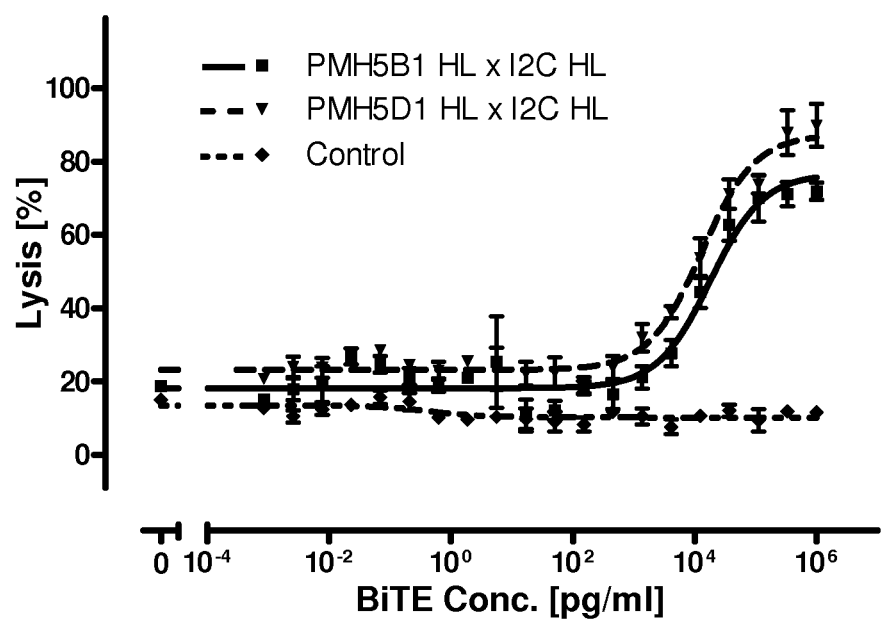

CROSS-SPECIES-SPECIFIC PSMAXCD3 BISPECIFIC SINGLE CHAIN ANTIBODY

The present invention relates to a bispecific single chain antibody molecule comprising a first binding domain capable of binding to an epitope of human and non-chimpanzee primate CD3 epsilon chain, wherein the epitope is part of an amino acid sequence comprised in the group consisting of SEQ ID NOs. 2, 4, 6, and 8, and a second binding domain capable of binding to prostate-specific membrane antigen (PSMA). The invention also provides nucleic acids encoding said bispecific single chain antibody molecule as well as vectors and host cells and a process for its production. The invention further relates to pharmaceutical compositions comprising said bispecific single chain antibody molecule and medical uses of said bispecific single chain antibody molecule.

T cell recognition is mediated by clonotypically distributed alpha beta and gamma delta T cell receptors (TcR) that interact with the peptide-loaded molecules of the peptide MHC (pMHC) (Davis & Bjorkman, Nature 334 (1988), 395-402). The antigen-specific chains of the TcR do not possess signalling domains but instead are coupled to the conserved multisubunit signaling apparatus CD3 (Call, Cell 111 (2002), 967-979, Alarcon, Immunol. Rev. 191 (2003), 38-46, Malissen Immunol. Rev. 191 (2003), 7-27). The mechanism by which TcR ligation is directly communicated to the signalling apparatus remains a fundamental question in T cell biology (Alarcon, loc. cit.; Davis, Cell 110 (2002), 285-287). It seems clear that sustained T cell responses involve coreceptor engagement, TcR oligomerization, and a higher order arrangement of TcR-pMHC complexes in the immunological synapse (Davis & van der Merwe, Curr. Biol. 11 (2001), R289-R291, Davis, Nat. Immunol. 4 (2003), 217-224). However very early TcR signalling occurs in the absence of these events and may involve a ligand-induced conformational change in CD3 epsilon (Alarcon, loc. cit., Davis (2002), loc. cit., Gil, J. Biol. Chem. 276 (2001), 11174-11179, Gil, Cell 109 (2002), 901-912). The epsilon, gamma, delta and zeta subunits of the signaling complex associate with each other to form a CD3 epsilon-gamma heterodimer, a CD3 epsilon-delta ☐heterodimer, and a CD3 zeta-zeta homodimer (Call, loc. cit.). Various studies have revealed that the CD3 molecules are important for the proper cell surface expression of the alpha beta TcR and normal T cell development (Berkhout, J. Biol. Chem. 263 (1988), 8528-8536, Wang, J. Exp. Med. 188 (1998), 1375-1380, Kappes, Curr. Opin. Immunol. 7 (1995), 441-447). The solution structure of the ectodomain fragments of the mouse CD3 epsilon gamma heterodimer showed that the epsilon gamma subunits are both C2-set Ig domains that interact with each other to form an unusual side-to-side dimer configuration (Sun, Cell 105 (2001), 913-923). Although the cysteine-rich stalk appears to play an important role in driving CD3 dimerization (Su, loc. cit., Borroto, J. Biol. Chem. 273 (1998), 12807-12816), interaction by means of the extracellular domains of CD3 epsilon and CD3 gamma is sufficient for assembly of these proteins with TcR beta (Manolios, Eur. J. Immunol. 24 (1994), 84-92, Manolios & Li, Immunol. Cell Biol. 73 (1995), 532-536). Although still controversial, the dominant stoichiometry of the TcR most likely comprises one alpha beta TcR, one CD3 epsilon gamma heterodimer, one CD3 epsilon delta heterodimer and one CD3 zeta zeta homodimer (Call, loc. cit.). Given the central role of the human CD3 epsilon gamma heterodimer in the immune response, the crystal structure of this complex bound to the therapeutic antibody OKT3 has recently been elucidated (Kjer-Nielsen, PNAS101, (2004), 7675-7680).

A number of therapeutic strategies modulate T cell immunity by targeting TcR signaling, particularly the anti-human CD3 monoclonal antibodies (mAbs) that are widely used clinically in immunosuppressive regimes. The CD3-specific mouse mAb OKT3 was the first mAb licensed for use in humans (Sgro, Toxicology 105 (1995), 23-29) and is widely used clinically as an immunosuppressive agent in transplantation (Chatenoud, Clin. Transplant 7 (1993), 422-430, Chatenoud, Nat. Rev. Immunol. 3 (2003), 123-132, Kumar, Transplant. Proc. 30 (1998), 1351-1352), type 1 diabetes (Chatenoud (2003), loc. cit.), and psoriasis (Utset, J. Rheumatol. 29 (2002), 1907-1913). Moreover, anti-CD3 mAbs can induce partial T cell signalling and clonal anergy (Smith, J. Exp. Med. 185 (1997), 1413-1422). OKT3 has been described in the literature as a potent T cell mitogen (Van Wauve, J. Immunol. 124 (1980), 2708-18) as well as a potent T cell killer (Wong, Transplantation 50 (1990), 683-9). OKT3 exhibits both of these activities in a time-dependent fashion; following early activation of T cells leading to cytokine release, upon further administration OKT3 later blocks all known T cell functions. It is due to this later blocking of T cell function that OKT3 has found such wide application as an immunosuppressant in therapy regimens for reduction or even abolition of allograft tissue rejection.

OKT3 reverses allograft tissue rejection most probably by blocking the function of all T cells, which play a major role in acute rejection. OKT3 reacts with and blocks the function of the CD3 complex in the membrane of human T cells, which is associated with the antigen recognition structure of T cells (TCR) and is essential for signal transduction. Which subunit of the TCR/CD3 is bound by OKT3 has been the subject of multiple studies. Though some evidence has pointed to a specificity of OKT3 for the epsilon-subunit of the TCR/CD3 complex (Tunnacliffe, Int. Immunol. 1 (1989), 546-50; Kjer-Nielsen, PNAS 101, (2004), 7675-7680). Further evidence has shown that OKT3 binding of the TCR/CD3 complex requires other subunits of this complex to be present (Salmeron, J. Immunol. 147 (1991), 3047-52).

Other well known antibodies specific for the CD3 molecule are listed in Tunnacliffe, Int. Immunol. 1 (1989), 546-50. As indicated above, such CD3 specific antibodies are able to induce various T cell responses such as lymphokine production (Von Wussow, J. Immunol. 127 (1981), 1197; Palacious, J. Immunol. 128 (1982), 337), proliferation (Van Wauve, J. Immunol. 124 (1980), 2708-18) and suppressor-T cell induction (Kunicka, in "Lymphocyte Typing II" 1 (1986), 223). That is, depending on the experimental conditions, CD3 specific monoclonal antibody can either inhibit or induce cytotoxicity (Leewenberg, J. Immunol. 134 (1985), 3770; Phillips, J. Immunol. 136 (1986) 1579; Platsoucas, Proc. Natl. Acad. Sci. USA 78 (1981), 4500; Itoh, Cell. Immunol. 108 (1987), 283-96; Mentzer, J. Immunol. 135 (1985), 34; Landegren, J. Exp. Med. 155 (1982), 1579; Choi (2001), Eur. J. Immunol. 31, 94-106; Xu (2000), Cell Immunol. 200, 16-26; Kimball (1995), Transpl. Immunol. 3, 212-221).

Although many of the CD3 antibodies described in the art have been reported to recognize the CD3 epsilon subunit of the CD3 complex, most of them bind in fact to conformational epitopes and, thus, only recognize CD3 epsilon in the native context of the TCR. Conformational epitopes are characterized by the presence of two or more discrete amino acid residues which are separated in the primary sequence, but come together on the surface of the molecule when the polypeptide folds into the native protein/antigen (Sela, (1969) Science 166, 1365 and Layer, (1990) Cell 61, 553-6).

The conformational epitopes bound by CD3 epsilon antibodies described in the art may be separated in two groups. In the major group, said epitopes are being formed by two CD3 subunits, e.g. of the CD3 epsilon chain and the CD3 gamma or CD3 delta chain. For example, it has been found in several studies that the most widely used CD3 epsilon monoclonal antibodies OKT3, WT31, UCHT1, 7D6 and Leu-4 did not bind to cells singly transfected with the CD3-epsilon chain. However, these antibodies stained cells doubly transfected with a combination of CD3 epsilon plus either CD3 gamma or CD3 delta (Tunnacliffe, loc. cit.; Law, Int. Immunol. 14 (2002), 389-400; Salmeron, J. Immunol. 147 (1991), 3047-52; Coulie, Eur. J. Immunol. 21 (1991), 1703-9). In a second smaller group, the conformational epitope is being formed within the CD3 epsilon subunit itself. A member of this group is for instance mAb APA 1/1 which has been raised against denatured CD3 epsilon (Risueno, Blood 106 (2005), 601-8). Taken together, most of the CD3 epsilon antibodies described in the art recognize conformational epitopes located on two or more subunits of CD3. The discrete amino acid residues forming the three-dimensional structure of these epitopes may hereby be located either on the CD3 epsilon subunit itself or on the CD3 epsilon subunit and other CD3 subunits such as CD3 gamma or CD3 delta.

Another problem with respect to CD3 antibodies is that many CD3 antibodies have been found to be species-specific. Anti-CD3 monoclonal antibodies—as holds true generally for any other monoclonal antibodies—function by way of highly specific recognition of their target molecules. They recognize only a single site, or epitope, on their target CD3 molecule. For example, one of the most widely used and best characterized monoclonal antibodies specific for the CD3 complex is OKT-3. This antibody reacts with chimpanzee CD3 but not with the CD3 homolog of other primates, such as macaques, or with dog CD3 (Sandusky et al., J. Med. Primatol. 15 (1986), 441-451). Similarly, WO2005/118635 or WO2007/033230 describe human monoclonal CD3 epsilon antibodies which react with human CD3 epsilon but not with CD3 epsilon of mouse, rat, rabbit or non-chimpanzee primates such as rhesus monkey, cynomolgus monkey or baboon monkey. The anti-CD3 monoclonal antibody UCHT-1 is also reactive with CD3 from chimpanzee but not with CD3 from macaques (own data). On the other hand, there are also examples of monoclonal antibodies, which recognize macaque antigens, but not their human counterparts. One example of this group is monoclonal antibody FN-18 directed to CD3 from macaques (Uda et al., J. Med. Primatol. 30 (2001), 141-147). Interestingly, it has been found that peripheral lymphocytes from about 12% of cynomolgus monkeys lacked reactivity with anti-rhesus monkey CD3 monoclonal antibody (FN-18) due to a polymorphism of the CD3 antigen in macaques. Uda et al. described a substitution of two amino acids in the CD3 sequence of cynomolgus monkeys, which are not reactive with FN-18 antibodies, as compared to CD3 derived from animals, which are reactive with FN-18 antibodies (Uda et al., J Med. Primatol. 32 (2003), 105-10; Uda et al., J Med. Primatol. 33 (2004), 34-7).

The discriminatory ability, i.e. the species specificity, inherent not only to CD3 monoclonal antibodies (and fragments thereof), but to monoclonal antibodies in general, is a significant impediment to their development as therapeutic agents for the treatment of human diseases. In order to obtain market approval any new candidate medication must pass through rigorous testing. This testing can be subdivided into preclinical and clinical phases: Whereas the latter—further subdivided into the generally known clinical phases I, II and III—is performed in human patients, the former is performed in animals. The aim of pre-clinical testing is to prove that the drug candidate has the desired activity and most importantly is safe. Only when the safety in animals and possible effectiveness of the drug candidate has been established in preclinical testing this drug candidate will be approved for clinical testing in humans by the respective regulatory authority. Drug candidates can be tested for safety in animals in the following three ways, (i) in a relevant species, i.e. a species where the drug candidates can recognize the ortholog antigens, (ii) in a transgenic animal containing the human antigens and (iii) by use of a surrogate for the drug candidate that can bind the ortholog antigens present in the animal. Limitations of transgenic animals are that this technology is typically limited to rodents. Between rodents and man there are significant differences in the physiology and the safety results cannot be easily extrapolated to humans. The limitations of a surrogate for the drug candidate are the different composition of matter compared to the actual drug candidate and often the animals used are rodents with the limitation as discussed above. Therefore, preclinical data generated in rodents are of limited predictive power with respect to the drug candidate. The approach of choice for safety testing is the use of a relevant species, preferably a lower primate. The limitation now of monoclonal antibodies suitable for therapeutic intervention in man described in the art is that the relevant species are higher primates, in particular chimpanzees. Chimpanzees are considered as endangered species and due to their human-like nature, the use of such animals for drug safety testing has been banned in Europe and is highly restricted elsewhere. CD3 has also been successfully used as a target for bispecific single chain antibodies in order to redirect cytotoxic T cells to pathological cells, resulting in the depletion of the diseased cells from the respective organism (WO 99/54440; WO 04/106380). For example, Bargou et al. (Science 321 (2008):974-7) have recently reported on the clinical activity of a CD19xCD3 bispecific antibody construct called blinatumomab, which has the potential to engage all cytotoxic T cells in human patients for lysis of cancer cells. Doses as low as 0.005 milligrams per square meter per day in non-Hodgkin's lymphoma patients led to an elimination of target cells in blood. Partial and complete tumor regressions were first observed at a dose level of 0.015 milligrams, and all seven patients treated at a dose level of 0.06 milligrams experienced a tumor regression. Blinatumomab also led to clearance of tumor cells from bone marrow and liver. Though this study established clinical proof of concept for the therapeutic potency of the bispecific single chain antibody format in treating blood-cell derived cancer, there is still need for successful concepts for therapies of other cancer types.

In 2008, an estimated 186,320 men will be newly diagnosed with prostate cancer in the United States and about 28,660 men will die from the disease. The most recent report available on cancer mortality shows that, in 2004, the overall death rate from prostate cancer among American men was 25 per 100,000. In the late 1980s, the widespread adoption of the prostate-specific antigen (PSA) test represented a major improvement in the management of prostate cancer. This test measures the amount of PSA protein in the blood, which is often elevated in patients with prostate cancer. In 1986, the U.S. Food and Drug Administration approved the use of the PSA test to monitor patients with prostate cancer and, in 1994, additionally approved its use as a screening test for this disease. Due to the widespread implementation of PSA testing in the United States, approximately 90 percent of all prostate cancers are currently diagnosed at an early stage, and, consequently, men are surviving longer after diagnosis. However, the results of two ongoing clinical trials, the NCI-sponsored Prostate, Lung, Colorectal, and Ovarian (PLCO) screening trial and the European Study of Screening for Prostate Cancer (ERSPC) will be needed to determine whether PSA screening actually saves lives. Ongoing clinical trials over the past 25 years have investigated the effectiveness of natural and synthetic compounds in the prevention of prostate cancer. For example, the Prostate Cancer Prevention Trial (PCPT), which enrolled nearly 19,000 healthy men, found that finasteride, a drug approved for the treatment of benign prostatic hyperplasia (BPH), which is a noncancerous enlargement of the prostate, reduced the risk of developing prostate cancer by 25 percent. Another trial, the Selenium and Vitamin E Cancer Prevention Trial (SELECT), is studying more than 35,000 men to determine whether daily supplements of selenium and vitamin E can reduce the incidence of prostate cancer in healthy men. Other prostate cancer prevention trials are currently evaluating the protective potential of multivitamins, vitamins C and D, soy, green tea, and lycopene, which is a natural compound found in tomatoes. One study, reported in 2005, showed that specific genes were fused in 60 to 80 percent of the prostate tumors analyzed. This study represents the first observation of non-random gene rearrangements in prostate cancer. This genetic alteration may eventually be used as a biomarker to aid in the diagnosis and, possibly, treatment of this disease. Other studies have shown that genetic variations in a specific region of chromosome 8 can increase a man's risk of developing prostate cancer. These genetic variations account for approximately 25 percent of the prostate cancers that occur in white men. They are the first validated genetic variants that increase the risk of developing prostate cancer and may help scientists better understand the genetic causes of this disease. There is also ongoing research that examines how proteins circulating in a patient's blood can be used to improve the diagnosis of prostate and other cancers. In 2005, scientists identified a group of specific proteins that are produced by a patient's immune system in response to prostate tumors. These proteins, a type of autoantibody, were able to detect the presence of prostate cancer cells in blood specimens with greater than 90 percent accuracy. When used in combination with PSA, these and other blood proteins may eventually be used to reduce the number of false-positive results obtained with PSA testing alone and, therefore, reduce the large number of unnecessary prostate biopsies that are performed each year due to false-positive PSA test results.

Apart from PSA, several other markers for prostate cancer have been identified, including e.g. the six-transmembrane epithelial antigen of the prostate (STEAP) (Hubert et al., PNAS 96 (1999), 14523-14528), the prostate stem cell antigen (PSCA) (Reiter et al., Proc. Nat. Acad. Sci. 95: 1735-1740, 1998) and the prostate-specific membrane antigen (PSMA; PSM) (Israeli et al., Cancer Res. 53 (1993). PSMA was originally defined by the monoclonal antibody (MAb) 7E11 derived from immunization with a partially purified membrane preparation from the lymph node prostatic adenocarcinoma (LNCaP) cell line (Horoszewicz et al., Anticancer Res. 7 (1987), 927-35). A 2.65-kb cDNA fragment encoding the PSMA protein was cloned and subsequently mapped to chromosome 11p11.2 (Israeli et al., loc. cit.; O'Keefe et al., Biochem. Biophys. Acta 1443 (1998), 113-127). Initial analysis of PSMA demonstrated widespread expression within the cells of the prostatic secretory epithelium. Immunohistochemical staining demonstrated that PSMA was absent to moderately expressed in hyperplastic and benign tissues, while malignant tissues stained with the greatest intensity (Horoszewicz et al., loc. cit.). Subsequent investigations have recapitulated these results and evinced PSMA expression as a universal feature in practically every prostatic tissue examined to date. These reports further demonstrate that expression of PSMA increases precipitously proportional to tumor aggressiveness (Burger et al., Int. J. Cancer 100 (2002), 228-237; Chang et al., Cancer Res. 59 (1999), 3192-98; Chang et al., Urology 57 (2001), 1179-83), Kawakami and Nakayama, Cancer Res. 57 (1997), 2321-24; Liu et al., Cancer Res. 57 (1997), 3629-34; Lopes et al., Cancer Res. 50 (1990), 6423-29; Silver et al., Clin. Cancer Res. 9 (2003), 6357-62; Sweat et al., Urology 52 (1998), 637-40; Troyer et al., Int. J. Cancer 62 (1995), 552-558; Wright et al., Urology 48 (1996), 326-334). Consistent with the correlation between PSMA expression and tumor stage, increased levels of PSMA are associated with androgen-independent prostate cancer (PCa). Analysis of tissue samples from patients with prostate cancer has demonstrated elevated PSMA levels after physical castration or androgen-deprivation therapy. Unlike expression of prostate specific antigen, which is downregulated after androgen ablation, PSMA expression is significantly increased in both primary and metastatic tumor specimens (Kawakami et al., Wright et al., loc. cit.). Consistent with the elevated expression in androgen-independent tumors, PSMA transcription is also known to be downregulated by steroids, and administration of testosterone mediates a dramatic reduction in PSMA protein and mRNA levels (Israeli et al., Cancer Res. 54 (1994), 1807-11; Wright et al., loc. cit.). PSMA is also highly expressed in secondary prostatic tumors and occult metastatic disease. Immunohistochemical analysis has revealed relatively intense and homogeneous expression of PSMA within metastatic lesions localized to lymph nodes, bone, soft tissue, and lungs compared with benign prostatic tissues (Chang et al. (2001), loc. cit.; Murphy et al., Cancer 78 (1996), 809-818; Sweat et al., loc. cit.). Some reports have also indicated limited PSMA expression in extraprostatic tissues, including a subset of renal proximal tubules, some cells of the intestinal brush-border membrane, and rare cells in the colonic crypts (Chang et al. (1999), Horoszewicz et al., Israeli et al. (1994), Lopes et al., Troyer et al., loc. cit.). However, the levels of PSMA in these tissues are generally two to three orders of magnitude less than those observed in the prostate (Sokoloff et al., Prostate 43 (2000), 150-157). PSMA is also expressed in the tumor-associated neovasculature of most solid cancers examined yet is absent in the normal vascular endothelium (Chang et al. (1999), Liu et al., Silver et al., loc. cit.). Although the significance of PSMA expression within the vasculature is unknown, the specificity for tumor-associated endothelium makes PSMA a potential target for the treatment of many forms of malignancy.

Though there has been put much effort in identifying novel targets for therapeutic approaches for cancer, cancer is yet one of the most frequently diagnosed diseases. In light of this, there is still need for effective treatments for cancer.

The present invention provides for a bispecific single chain antibody molecule comprising a first binding domain capable of binding to an epitope of human and non-chimpanzee primate CD3ε (epsilon) chain, wherein the epitope is part of an amino acid sequence comprised in the group consisting of SEQ ID NOs. 2, 4, 6, and 8; and a second binding domain capable of binding to prostate-specific membrane antigen (PSMA).

Though T cell-engaging bispecific single chain antibodies described in the art have great therapeutic potential for the treatment of malignant diseases, most of these bispecific molecules are limited in that they are species specific and recognize only human antigen, and—due to genetic similarity—likely the chimpanzee counterpart. The advantage of the present invention is the provision of a bispecific single chain antibody comprising a binding domain exhibiting cross-species specificity to human and non-chimpanzee primate of the CD3 epsilon chain.

In the present invention, an N-terminal 1-27 amino acid residue polypeptide fragment of the extracellular domain of CD3 epsilon was surprisingly identified which—in contrast to all other known epitopes of CD3 epsilon described in the art—maintains its three-dimensional structural integrity when taken out of its native environment in the CD3 complex (and optionally fused to a heterologous amino acid sequence such as EpCAM or an immunoglobulin Fc part). The present invention, therefore, provides for a bispecific single chain antibody molecule comprising a first binding domain capable of binding to an epitope of an N-terminal 1-27 amino acid residue polypeptide fragment of the extracellular domain of CD3 epsilon (which CD3 epsilon is, for example, taken out of its native environment and/or comprised by (presented on the surface of) a T-cell) of human and at least one non-chimpanzee primate CD3 epsilon chain, wherein the epitope is part of an amino acid sequence comprised in the group consisting of SEQ ID NOs. 2, 4, 6, and 8; and a second binding domain capable of binding to prostate-specific membrane antigen (PSMA). Preferred non-chimpanzee primates are mentioned herein elsewhere. At least one (or a selection thereof or all) primate(s) selected from *Callithrix jacchus; Saguinus oedipus, Saimiri sciureus*, and *Macaca fascicularis* (either SEQ ID 631 or 632 or both), is (are) particularily preferred. *Macaca mulatta*, also known as Rhesus Monkey is also envisaged as another preferred primate. It is thus envisaged that antibodies of the invention bind to (are capable of binding to) the context independent epitope of an N-terminal 1-27 amino acid residue polypeptide fragment of the extracellular domain of CD3 epsilon of human and *Callithrix jacchus, Saguinus oedipus, Saimiri sciureus*, and *Macaca fascicularis* (either SEQ ID 631 or 632 or both), and optionally also to *Macaca mulatta*. A bispecific single chain antibody molecule comprising a first binding domain as defined herein can be obtained (is obtainable by) or can be manufactured in accordance with the protocol set out in WO 2008/119567 (in particular Example 2 of WO 2008/119567). To this end, it is envisaged to (a) immunize mice with an N-terminal 1-27 amino acid residue polypeptide fragment of the extracellular domain of CD3 epsilon of human and/or *Saimiri sciureus*; (b) generation of an immune murine antibody scFv library; (c) identification of CD3 epsilon specific binders by testing the capability to bind to at least SEQ ID NOs. 2, 4, 6, and 8.

The context-independence of the CD3 epitope provided in this invention corresponds to the first 27 N-terminal amino acids of CD3 epsilon or functional fragments of this 27 amino acid stretch. The phrase "context-independent," as used herein in relation to the CD3 epitope means that binding of the herein described inventive binding molecules/antibody molecules does not lead to a change or modification of the conformation, sequence, or structure surrounding the antigenic determinant or epitope. In contrast, the CD3 epitope recognized by a conventional CD3 binding molecule (e.g. as disclosed in WO 99/54440 or WO 04/106380) is localized on the CD3 epsilon chain C-terminally to the N-terminal 1-27 amino acids of the context-independent epitope, where it only takes the correct conformation if it is embedded within the rest of the epsilon chain and held in the right sterical position by heterodimerization of the epsilon chain with either the CD3 gamma or delta chain. Anti-CD3 binding domains as part of a PSMAxCD3 bispecific single chain molecule as provided herein have been described in WO 2008/119567. These binding domains are generated (and directed) against a context-independent CD3 epitope provide for a surprising clinical improvement with regard to T cell redistribution and, thus, a more favourable safety profile. Without being bound by theory, since the CD3 epitope is context-independent, forming an autonomous selfsufficient subdomain without much influence on the rest of the CD3 complex, the CD3 binding domain of the PSMAxCD3 bispecific single chain molecule provided herein induces less allosteric changes in CD3 conformation than the conventional CD3 binding molecules (like molecules provided in WO 99/54440 or WO 04/106380), which recognize context-dependent CD3 epitopes.

The context-independence of the CD3 epitope which is recognized by the CD3 binding domain of the PSMAxCD3 bispecific single chain antibody of the invention is associated with less or no T cell redistribution (T cell redistribution equates with an initial episode of drop and subsequent recovery of absolute T cell counts) during the starting phase of treatment with said PSMAxCD3 bispecific single chain antibody of the invention. These results in a better safety profile of the PSMAxCD3 bispecific single chain antibody of the invention compared to conventional CD3 binding molecules known in the art, which recognize context-dependent CD3 epitopes. Particularly, because T cell redistribution during the starting phase of treatment with CD3 binding molecules is a major risk factor for adverse events, like CNS adverse events, the PSMAxCD3 bispecific single chain antibody of the invention by recognizing a context-independent rather than a context-dependent CD3 epitope has a substantial safety advantage over the CD3 binding molecules known in the art. Patients with such CNS adverse events related to T cell redistribution during the starting phase of treatment with conventional CD3 binding molecules usually suffer from confusion and disorientation, in some cases also from urinary incontinence. Confusion is a change in mental status in which the patient is not able to think with his or her usual level of clarity. The patient usually has difficulties to concentrate and thinking is not only blurred and unclear but often significantly slowed down. Patients with CNS adverse events related to T cell redistribution during the starting phase of treatment with conventional CD3 binding molecules may also suffer from loss of memory. Frequently, the confusion leads to the loss of ability to recognize people, places, time or the date. Feelings of disorientation are common in confusion, and the decision-making ability is impaired. CNS adverse events related to T cell redistribution during the starting phase of treatment with conventional CD3 binding molecules may further comprise blurred speech and/or word finding difficulties. This disorder may impair both, the expression and understanding of language as well as reading and writing. Besides urinary incontinence, vertigo and dizziness may also accompany CNS adverse events related to T cell redistribution during the starting phase of treatment with conventional CD3 binding molecules in some patients.

The maintenance of the three-dimensional structure within the mentioned 27 amino acid N-terminal polypeptide fragment of CD3 epsilon can be used for the generation of, preferably human, binding domains which are capable of binding to the N-terminal CD3 epsilon polypeptide fragment in vitro and to the native (CD3 epsilon subunit of the) CD3 complex on T cells in vivo with the same binding affinity. These data strongly indicate that the N-terminal fragment as described herein forms a tertiary conformation, which is similar to its structure normally existing in vivo. A very sensitive test for the importance of the structural integrity of the amino acids 1-27 of the N-terminal polypeptide fragment of CD3 epsilon was performed. Individual amino acids of amino acids 1-27 of the N-terminal polypeptide fragment of CD3 epsilon were changed to alanine (alanine scanning) to test the sensitivity of the amino acids 1-27 of the N-terminal polypeptide fragment of CD3 epsilon for minor disruptions. The CD3 specific binding domains as part of the PSMAxCD3 bispecific single chain antibody of the invention were used to test for binding to the alanine-mutants of amino acids 1-27 of the N-terminal polypeptide fragment of CD3 epsilon (see WO 2008/119567). Individual exchanges of the first five amino acid residues at the very N-terminal end of the fragment and two of the amino acids at positions 23 and 25 of the amino acids 1-27 of the N-terminal polypeptide fragment of CD3 epsilon were critical for binding of the antibody molecules. The substitution of amino acid residues in the region of position 1-5 comprising the residues Q (Glutamine at position 1), D (Aspartic acid at position 2), G (Glycine at position 3), N (Asparagine at position 4), and E (Glutamic acid at position 5) to Alanine abolished binding of the, preferably human, PSMAxCD3 bispecific single chain antibody of the invention to said fragment. While, for at least some of the, preferably human, PSMAxCD3 bispecific single chain antibody of the invention, two amino acid residues at the C-terminus of the mentioned fragment T (Threonine at position 23) and I (Isoleucine at position 25) reduced the binding energy to the, preferably human, PSMAxCD3 bispecific single chain antibody of the invention.

Unexpectedly, it has been found that the thus isolated, preferably human, PSMAxCD3 bispecific single chain antibody of the invention not only recognizes the human N-terminal fragment of CD3 epsilon, but also the corresponding homologous fragments of CD3 epsilon of various primates, including New-World Monkeys (Marmoset, *Callithrix jacchus; Saguinus oedipus; Saimiri sciureus*) and Old-World Monkeys (*Macaca fascicularis*, also known as Cynomolgus Monkey; or *Macaca mulatta*, also known as Rhesus Monkey). Thus, multi-primate specificity of the PSMAxCD3 bispecific single chain antibody of the invention was detected. The following sequence analyses confirmed that human and primates share a highly homologous sequence stretch at the N-terminus of the extracellular domain of CD3 epsilon.

The amino acid sequence of the aforementioned N-terminal fragments of CD3 epsilon are depicted in SEQ ID No. 2 (human), SEQ ID No. 4 (*Callithrix jacchus*); SEQ ID No. 6 (*Saguinus oedipus*); SEQ ID No. 8 (*Saimiri sciureus*); SEQ ID No. 631 QDGNEEMGSITQTPYQVSISGTTILTC or SEQ ID No. 632 QDGNEEMGSITQTPYQVSISGTTVILT (*Macaca fascicularis*, also known as Cynomolgus Monkey), and SEQ ID No. 633 QDGNEEMGSITQTPYHVSISGTTVILT (*Macaca mulatta*, also known as Rhesus Monkey).

The second binding domain of the PSMAxCD3 bispecific single chain antibody of the invention binds to the prostate-specific membrane antigen (PSMA). Preferably, the second binding domain of the PSMAxCD3 bispecific single chain antibody binds to the human PSMA or a non-chimpanzee primate PSMA; more preferred it binds to the human PSMA and a non-chimpanzee primate PSMA and therefore is cross-species specific; even more preferred to the human PSMA and the macaque PSMA (and therefore is cross-species specific as well). Particularly preferred, the macaque PSMA is the Cynomolgus monkey PSMA and/or the Rhesus monkey PSMA. However, it is not excluded from the scope of the present invention, that the second binding domain may also bind to PSMA homologs of other species, such as to the PSMA homolog in rodents.

Prostate cancer is the second most cancer in men. For 2008, it is estimated that 186,320 men will be newly diagnosed with prostate cancer in the United States and about 28,660 men will die from the disease. Prostate cancer risk is strongly related to age: very few cases are registered in men under 50 and three-quarters of cases occur in men over 65 years. The largest number of cases is diagnosed in those aged 70-74. Currently, the growth rate of the older population is significantly higher than that of the total population. By 2025-2030, projections indicate that the population over 60 will be growing 3.5 times as rapidly as the total population. The proportion of older persons is projected to more than double worldwide over the next half century, which means that a further increase in incidence of diagnosed prostate cancer has to be expected for the future. The highly restricted expression of PSMA and its upregulation in advanced stages and metastatic disease of prostate cancer as well as its role as neoantigen on tumor vasculature of many different types of other solid tumors qualifies PSMA as attractive target antigen for antibody-based cancer therapy. As shown in the following examples, the PSMAxCD3 bispecific single chain antibody of the invention provides an advantageous tool in order to kill PSMA-expressing human cancer cells, as exemplified by the human prostate cancer cell line LNCaP. In addition, the cytotoxic activity of the PSMAxCD3 bispecific single chain antibody of the invention is higher than the cytotoxic activity of antibodies described in the art. Since preferably both the CD3 and the PSMA binding domain of the PSMAxCD3 bispecific single chain antibody of the invention are cross-species specific, i.e. reactive with the human and non-chimpanzee primates antigens, it can be used for preclinical evaluation of safety, activity and/or pharmacokinetic profile of these binding domains in primates and—in the identical form—as drug in humans.

Advantageously, the present invention provides also PSMAxCD3 bispecific single chain antibodies comprising a second binding domain which binds both to the human PSMA and to the macaque PSMA homolog, i.e. the homolog of a non-chimpanzee primate. In a preferred embodiment, the bispecific single chain antibody thus comprises a second binding domain exhibiting cross-species specificity to the human and a non-chimpanzee primate PSMA. In this case, the identical bispecific single chain antibody molecule can be used both for preclinical evaluation of safety, activity and/or pharmacokinetic profile of these binding domains in primates and as drug in humans. Put in other words, the same molecule can be used in preclinical animal studies as well as in clinical studies in humans. This leads to highly comparable results and a much-increased predictive power of the animal studies compared to species-specific surrogate molecules. Since both the CD3 and the PSMA binding domain of the PSMAxCD3 bispecific single chain antibody of the invention are cross-species specific, i.e. reactive with the human and non-chimpanzee primates' antigens, it can be used both for preclinical evaluation of safety, activity and/or pharmacokinetic profile of these binding domains in primates and—in the identical form—as drug in humans. It will be understood that in a preferred embodiment, the cross-species specificity of the first and second binding domain of the antibodies of the invention is identical.

It has been found in the present invention that it is possible to generate a, preferably human, PSMAxCD3 bispecific single chain antibody wherein the identical molecule can be used in preclinical animal testing, as well as clinical studies and even in therapy in human. This is due to the unexpected identification of the, preferably human, PSMAxCD3 bispecific single chain antibody, which, in addition to binding to human CD3 epsilon and PSMA, respectively, (and due to genetic similarity likely to the chimpanzee counterpart), also binds to the homologs of said antigens of non-chimpanzee primates, including New-World Monkeys and Old-World Monkeys. As shown in the following Examples, said preferably human, PSMAxCD3 bispecific single chain antibody of the invention can be used as therapeutic agent against various diseases, including, but not limited, to cancer. The PSMAxCD3 bispecific single chain antibody is particularly advantageous for the therapy of cancer, preferably solid tumors, more preferably carcinomas and prostate cancer. In view of the above, the need to construct a surrogate PSMAxCD3 bispecific single chain antibody for testing in a phylogenetic distant (from humans) species disappears. As a result, the identical molecule can be used in animal preclinical testing as is intended to be administered to humans in clinical testing as well as following market approval and therapeutic drug administration. The ability to use the same molecule for preclinical animal testing as in later administration to humans virtually eliminates, or at least greatly reduces, the danger that the data obtained in preclinical animal testing have limited applicability to the human case. In short, obtaining preclinical safety data in animals using the same molecule as will actually be administered to humans does much to ensure the applicability of the data to a human-relevant scenario. In contrast, in conventional approaches using surrogate molecules, said surrogate molecules have to be molecularly adapted to the animal test system used for preclinical safety assessment. Thus, the molecule to be used in human therapy in fact differs in sequence and also likely in structure from the surrogate molecule used in preclinical testing in pharmacokinetic parameters and/or biological activity, with the consequence that data obtained in preclinical animal testing have limited applicability/transferability to the human case. The use of surrogate molecules requires the construction, production, purification and characterization of a completely new construct. This leads to additional development costs and time necessary to obtain that molecule. In sum, surrogates have to be developed separately in addition to the actual drug to be used in human therapy, so that two lines of development for two molecules have to be carried out. Therefore, a major advantage of the, preferably human, PSMAxCD3 bispecific single chain antibody of the invention exhibiting cross-species specificity described herein is that the identical molecule can be used for therapeutic agents in humans and in preclinical animal testing.

It is preferred that at least one of said first or second binding domains of the bispecific single chain antibody of the invention is CDR-grafted, humanized or human, as set forth in more detail below. Preferably, both the first and second binding domains of the bispecific single chain antibody of the invention are CDR-grafted, humanized or human. For the preferably human, PSMAxCD3 bispecific single chain antibody of the invention, the generation of an immune reaction against said binding molecule is excluded to the maximum possible extent upon administration of the molecule to human patients.

Another major advantage of the, preferably human, PSMAxCD3 bispecific single chain antibody of the invention is its applicability for preclinical testing in various primates. The behavior of a drug candidate in animals should ideally be indicative of the expected behavior of this drug candidate upon administration to humans. As a result, the data obtained from such preclinical testing should therefore generally have a highly predictive power for the human case. However, as learned from the tragic outcome of the recent Phase I clinical trial on TGN1412 (a CD28 monoclonal antibody), a drug candidate may act differently in a primate species than in humans: Whereas in preclinical testing of said antibody no or only limited adverse effects have been observed in animal studies performed with cynomolgus monkeys, six human patients developed multiple organ failure upon administration of said antibody (Lancet 368 (2006), 2206-7). The results of these dramatic, non-desired negative events suggest that it may not be sufficient to limit preclinical testing to only one (non-chimpanzee primate) species. The fact that the PSMAxCD3 bispecific single chain antibody of the invention binds to a series of New-World and Old-World Monkeys may help to overcome the problems faced in the case mentioned above. Accordingly, the present invention provides means and methods for minimizing species differences in effects when drugs for human therapy are being developed and tested.

With the, preferably human, cross-species specific PSMAxCD3 bispecific single chain antibody of the invention it is also no longer necessary to adapt the test animal to the drug candidate intended for administration to humans, such as e.g. the creation of transgenic animals. The, preferably human, PSMAxCD3 bispecific single chain antibody of the invention exhibiting cross-species specificity according to the uses and the methods of invention can be directly used for preclinical testing in non-chimpanzee primates, without any genetic manipulation of the animals. As well known to those skilled in the art, approaches in which the test animal is adapted to the drug candidate always bear the risk that the results obtained in the preclinical safety testing are less representative and predictive for humans due to the modification of the animal. For example, in transgenic animals, the proteins encoded by the transgenes are often highly over-expressed. Thus, data obtained for the biological activity of an antibody against this protein antigen may be limited in their predictive value for humans in which the protein is expressed at much lower, more physiological levels.

A further advantage of the uses of the preferably human PSMAxCD3 bispecific single chain antibody of the invention exhibiting cross-species specificity is the fact that chimpanzees as an endangered species are avoided for animal testing. Chimpanzees are the closest relatives to humans and were recently grouped into the family of hominids based on the genome sequencing data (Wildman et al., PNAS 100 (2003), 7181). Therefore, data obtained with chimpanzee is generally considered to be highly predictive for humans. However, due to their status as endangered species, the number of chimpanzees, which can be used for medical experiments, is highly restricted. As stated above, maintenance of chimpanzees for animal testing is therefore both costly and ethically problematic. The uses of the, preferably human, PSMAxCD3 bispecific single chain antibody of the invention avoid both ethical objections and financial burden during preclinical testing without prejudicing the quality, i.e. applicability, of the animal testing data obtained. In light of this, the uses of the, preferably human, PSMAxCD3 bispecific single chain antibody of the invention provide for a reasonable alternative for studies in chimpanzees.

A still further advantage of the, preferably human, PSMAxCD3 bispecific single chain antibody of the invention is the ability of extracting multiple blood samples when using it as part of animal preclinical testing, for example in the course of pharmacokinetic animal studies. Multiple blood extractions can be much more readily obtained with a non-chimpanzee primate than with lower animals, e.g. a mouse. The extraction of multiple blood samples allows continuous testing of blood parameters for the determination of the biological effects induced by the, preferably human, PSMAxCD3 bispecific single chain antibody of the invention. Furthermore, the extraction of multiple blood samples enables the researcher to evaluate the pharmacokinetic profile of the, preferably human, PSMAxCD3 bispecific single chain antibody of the invention as defined herein. In addition, potential side effects, which may be induced by said, preferably human, PSMAxCD3 bispecific single chain antibody of the invention reflected in blood parameters can be measured in different blood samples extracted during the course of the administration of said antibody.

This allows the determination of the potential toxicity profile of the, preferably human, PSMAxCD3 bispecific single chain antibody of the invention as defined herein.

The advantages of the, preferably human, PSMAxCD3 bispecific single chain antibody of the invention as defined herein exhibiting cross-species specificity may be briefly summarized as follows:

First, the, preferably human, PSMAxCD3 bispecific single chain antibody of the invention as defined herein used in preclinical testing is the same as the one used in human therapy. Thus, it is no longer necessary to develop two independent molecules, which may differ in their pharmacokinetic properties and biological activity. This is highly advantageous in that e.g. the pharmacokinetic results are more directly transferable and applicable to the human setting than e.g. in conventional surrogate approaches.

Second, the uses of the, preferably human, PSMAxCD3 bispecific single chain antibody of the invention as defined herein for the preparation of therapeutics in human is less cost- and labor-intensive than surrogate approaches.

Third, the, preferably human, PSMAxCD3 bispecific single chain antibody of the invention as defined herein can be used for preclinical testing not only in one primate species, but in a series of different primate species, thereby limiting the risk of potential species differences between primates and human.

Fourth, chimpanzee as an endangered species for animal testing can be avoided if desired.

Fifth, multiple blood samples can be extracted for extensive pharmacokinetic studies.

Sixth, due to the human origin of the, preferably human, binding molecules according to a preferred embodiment of the invention, the generation of an immune reaction against said binding molecules is minimalized when administered to human patients. Induction of an immune response with antibodies specific for a drug candidate derived from a non-human species as e.g. a mouse leading to the development of human-anti-mouse antibodies (HAMAs) against therapeutic molecules of murine origin is excluded.

Last but not least, the therapeutic use of the PSMAxCD3 bispecific single chain antibody of the invention provides a novel and inventive therapeutic approach for cancer, preferably solid tumors, more preferably carcinomas and prostate cancer. As shown in the following examples, the PSMAxCD3 bispecific single chain antibody of the invention provides an advantageous tool in order to kill PSMA-expressing human prostate cancer cells. Moreover, the cytotoxic activity of the PSMAxCD3 bispecific single chain antibody of the invention is higher than the activity of antibodies described in the art.

As noted herein above, the present invention provides polypeptides, i.e. bispecific single chain antibodies, comprising a first binding domain capable of binding to an epitope of human and non-chimpanzee primate CD3ε chain and a second binding domain capable of binding to PSMA. The second binding domain preferably binds to human PSMA and a non-chimpanzee primate PSMA. The advantage of bispecific single chain antibody molecules as drug candidates fulfilling the requirements of the preferred bispecific single chain antibody of the invention is the use of such molecules in preclinical animal testing as well as in clinical studies and even for therapy in human. In a preferred embodiment of the cross-species specific bispecific single chain antibodies of the invention the second binding domain binding to PSMA is human. In a cross-species specific bispecific molecule according to the invention the binding domain binding to an epitope of human and non-chimpanzee primate CD3 epsilon chain is located in the order VH-VL or VL-VH at the N-terminus or the C-terminus of the bispecific molecule. Examples for cross-species specific bispecific molecules according to the invention in different arrangements of the VH- and the VL-chain in the first and the second binding domain are described in the appended examples.

As used herein, a "bispecific single chain antibody" denotes a single polypeptide chain comprising two binding domains. Each binding domain comprises one variable region from an antibody heavy chain ("VH region"), wherein the VH region of the first binding domain specifically binds to the CD3ε molecule, and the VH region of the second binding domain specifically binds to PSMA. The two binding domains are optionally linked to one another by a short polypeptide spacer. A non-limiting example for a polypeptide spacer is Gly-Gly-Gly-Gly-Ser (G-G-G-G-S) and repeats thereof. Each binding domain may additionally comprise one variable region from an antibody light chain ("VL region"), the VH region and VL region within each of the first and second binding domains being linked to one another via a polypeptide linker, for example of the type disclosed and claimed in EP 623679 B1, but in any case long enough to allow the VH region and VL region of the first binding domain and the VH region and VL region of the second binding domain to pair with one another such that, together, they are able to specifically bind to the respective first and second binding domains.

The term "protein" is well known in the art and describes biological compounds. Proteins comprise one or more amino acid chains (polypeptides), whereby the amino acids are bound among one another via a peptide bond. The term "polypeptide" as used herein describes a group of molecules, which consists of more than 30 amino acids. In accordance with the invention, the group of polypeptides comprises "proteins" as long as the proteins consist of a single polypeptide chain. Also in line with the definition the term "polypeptide" describes fragments of proteins as long as these fragments consist of more than 30 amino acids. Polypeptides may further form multimers such as dimers, trimers and higher oligomers, i.e. consisting of more than one polypeptide molecule. Polypeptide molecules forming such dimers, trimers etc. may be identical or non-identical.

The corresponding higher order structures of such multimers are, consequently, termed homo- or heterodimers, homo- or heterotrimers etc. An example for a hereteromultimer is an antibody molecule, which, in its naturally occurring form, consists of two identical light polypeptide chains and two identical heavy polypeptide chains. The terms "polypeptide" and "protein" also refer to naturally modified polypeptides/proteins wherein the modification is effected e.g. by post-translational modifications like glycosylation, acetylation, phosphorylation and the like. Such modifications are well known in the art.

The term "binding domain" characterizes in connection with the present invention a domain of a polypeptide which specifically binds to/interacts with a given target structure/antigen/epitope. Thus, the binding domain is an "antigen-interaction-site". The term "antigen-interaction-site" defines, in accordance with the present invention, a motif of a polypeptide, which is able to specifically interact with a specific antigen or a specific group of antigens, e.g. the identical antigen in different species. Said binding/interaction is also understood to define a "specific recognition". The term "specifically recognizing" means in accordance with this invention that the antibody molecule is capable of specifically interacting with and/or binding to at least two, preferably at least three, more preferably at least four amino acids of an antigen, e.g. the human CD3 antigen as defined herein. Such binding may be exemplified by the specificity of a "lock-and-key-principle". Thus, specific motifs in the amino acid sequence of the binding domain and the antigen bind to each other as a result of their primary, secondary or tertiary structure as well as the result of secondary modifications of said structure. The specific interaction of the antigen-interaction-site with its specific antigen may result as well in a simple binding of said site to the antigen. Moreover, the specific interaction of the binding domain/antigen-interaction-site with its specific antigen may alternatively result in the initiation of a signal, e.g. due to the induction of a change of the conformation of the antigen, an oligomerization of the antigen, etc. A preferred example of a binding domain in line with the present invention is an antibody. The binding domain may be a monoclonal or polyclonal antibody or derived from a monoclonal or polyclonal antibody.

The term "antibody" comprises derivatives or functional fragments thereof which still retain the binding specificity. Techniques for the production of antibodies are well known in the art and described, e.g. in Harlow and Lane "Antibodies, A Laboratory Manual", Cold Spring Harbor Laboratory Press, 1988, Harlow and Lane "Using Antibodies: A Laboratory Manual" Cold Spring Harbor Laboratory Press, 1999 and Little "Recombinant Antibodies for Immunotherapy" Cambridge University Press 2009. The term "antibody" also comprises immunoglobulins (Ig's) of different classes (i.e. IgA, IgG, IgM, IgD and IgE) and subclasses (such as IgG1, IgG2 etc.). The definition of the term "antibody" also includes embodiments such as chimeric, single chain and humanized antibodies, as well as antibody fragments, like, inter alia, Fab fragments. Antibody fragments or derivatives further comprise $F(ab')_2$, Fv, scFv fragments or single domain antibodies, single variable domain antibodies or immunoglobulin single variable domain comprising merely one variable domain, which might be VH or VL, that specifically bind to an antigen or epitope independently of other V regions or domains; see, for example, Harlow and Lane (1988) and (1999) and Little (2009), loc. cit. Such immunoglobulin single variable domain encompasses not only an isolated antibody single variable domain polypeptide, but also larger polypeptides that comprise one or more monomers of an antibody single variable domain polypeptide sequence.

Various procedures are known in the art and may be used for the production of such antibodies and/or fragments. Thus, the (antibody) derivatives can also be produced by peptidomimetics. Further, techniques described for the production of single chain antibodies (see, inter alia, U.S. Pat. No. 4,946,778) can be adapted to produce single chain antibodies specific for elected polypeptide(s). Also, transgenic animals may be used to express humanized or human antibodies specific for polypeptides and fusion proteins of this invention. For the preparation of monoclonal antibodies, any technique, providing antibodies produced by continuous cell line cultures can be used. Examples for such techniques include the hybridoma technique (Köhler and Milstein Nature 256 (1975), 495-497), the trioma technique, the human B-cell hybridoma technique (Kozbor, Immunology Today 4 (1983), 72) and the EBV-hybridoma technique to produce human monoclonal antibodies (Cole et al., Monoclonal Antibodies and Cancer Therapy, Alan R. Liss, Inc. (1985), 77-96). Surface plasmon resonance as employed in the BIAcore system can be used to increase the efficiency of phage antibodies which bind to an epitope of a target polypeptide, such as CD3 epsilon or PSMA (Schier, Human Antibodies Hybridomas 7 (1996), 97-105; Malmborg, J. Immunol. Methods 183 (1995), 7-13). It is also envisaged in the context of this invention that the term "antibody" comprises antibody constructs, which may be expressed in a host as described herein below, e.g. antibody constructs which may be transfected and/or transduced via, inter alia, viruses or plasmid vectors.

The term "specific interaction" as used in accordance with the present invention means that the binding domain does not or does not significantly cross-react with polypeptides which have similar structure as those bound by the binding domain, and which might be expressed by the same cells as the polypeptide of interest. Cross-reactivity of a panel of binding domains under investigation may be tested, for example, by assessing binding of said panel of binding domains under conventional conditions (see, e.g., Harlow and Lane (1988) and (1999) and Little (2009), loc. cit. Examples for the specific interaction of a binding domain with a specific antigen comprise the specificity of a ligand for its receptor. Said definition particularly comprises the interaction of ligands, which induce a signal upon binding to its specific receptor. Examples for said interaction, which is also particularly comprised by said definition, is the interaction of an antigenic determinant (epitope) with the binding domain (antigenic binding site) of an antibody.

The term "cross-species specificity" or "interspecies specificity" as used herein means binding of a binding domain described herein to the same target molecule in humans and non-chimpanzee primates. Thus, "cross-species specificity" or "interspecies specificity" is to be understood as an interspecies reactivity to the same molecule "X" expressed in different species, but not to a molecule other than "X". Cross-species specificity of a monoclonal antibody recognizing e.g. human CD3 epsilon, to a non-chimpanzee primate CD3 epsilon, e.g. macaque CD3 epsilon, can be determined, for instance, by FACS analysis. The FACS analysis is carried out in a way that the respective monoclonal antibody is tested for binding to human and non-chimpanzee primate cells, e.g. macaque cells, expressing said human and non-chimpanzee primate CD3 epsilon antigens, respectively. An appropriate assay is shown in the following examples. The above-mentioned subject matter applies mutatis mutandis for the PSMA antigen: Cross-species specificity of a monoclonal antibody recognizing e.g. human PSMA, to a non-chimpanzee primate PSMA, e.g. macaque PSMA, can be determined, for instance, by FACS analysis. The FACS analysis is carried out in a way that the respective monoclonal antibody is tested for binding to human and non-chimpanzee primate cells, e.g. macaque cells, expressing said human and non-chimpanzee primate PSMA antigens, respectively.

As used herein, CD3 epsilon denotes a molecule expressed as part of the T cell receptor and has the meaning as typically ascribed to it in the prior art. In human, it encompasses in individual or independently combined form all known CD3 subunits, for example CD3 epsilon, CD3 delta, CD3 gamma, CD3 zeta, CD3 alpha and CD3 beta. The non-chimpanzee primate, non-human CD3 antigens as referred to herein are, for example, *Macaca fascicularis* CD3 and *Macaca mulatta* CD3. In *Macaca fascicularis*, it encompasses CD3 epsilon FN-18 negative and CD3 epsilon FN-18 positive, CD3 gamma and CD3 delta. In *Macaca mulatta*, it encompasses CD3 epsilon, CD3 gamma and CD3 delta. Preferably, said CD3 as used herein is CD3 epsilon.

The human CD3 epsilon is indicated in GenBank Accession No. NM_000733 and comprises SEQ ID NO. 1. The human CD3 gamma is indicated in GenBank Accession NO. NM_000073. The human CD3 delta is indicated in GenBank Accession No. NM_000732.

The CD3 epsilon "FN-18 negative" of *Macaca fascicularis* (i.e. CD3 epsilon not recognized by monoclonal antibody FN-18 due to a polymorphism as set forth above) is indicated in GenBank Accession No. AB073994.

The CD3 epsilon "FN-18 positive" of *Macaca fascicularis* (i.e. CD3 epsilon recognized by monoclonal antibody FN-18) is indicated in GenBank Accession No. AB073993. The CD3 gamma of *Macaca fascicularis* is indicated in GenBank Accession No. AB073992. The CD3 delta of *Macaca fascicularis* is indicated in GenBank Accession No. AB073991.

The nucleic acid sequences and amino acid sequences of the respective CD3 epsilon, gamma and delta homologs of *Macaca mulatta* can be identified and isolated by recombinant techniques described in the art (Sambrook et al. Molecular Cloning: A Laboratory Manual; Cold Spring Harbor Laboratory Press, 3$^{rd}$ edition 2001). This applies mutatis mutandis to the CD3 epsilon, gamma and delta homologs of other non-chimpanzee primates as defined herein. The identification of the amino acid sequence of *Callithrix jacchus, Saimiri sciureus* and *Saguinus oedipus* is described in the appended examples. The amino acid sequence of the extracellular domain of the CD3 epsilon of *Callithrix jacchus* is depicted in SEQ ID NO: 3, the one of *Saguinus oedipus* is depicted in SEQ ID NO: 5 and the one of *Saimiri sciureus* is depicted in SEQ ID NO: 7.

The human PSMA is indicated in GenBank Accession No. 'AY101595'. The cloning of the PSMA homolog of macaque is demonstrated in the following examples, the corresponding cDNA and amino acid sequences are shown in SEQ ID NOs. 223 and 224, respectively.

In line with the above, the term "epitope" defines an antigenic determinant, which is specifically bound/identified by a binding domain as defined herein. The binding domain may specifically bind to/interact with conformational or continuous epitopes, which are unique for the target structure, e.g. the human and non-chimpanzee primate CD3 epsilon chain or the human and non-chimpanzee primate PSMA. A conformational or discontinuous epitope is characterized for polypeptide antigens by the presence of two or more discrete amino acid residues which are separated in the primary sequence, but come together on the surface of the molecule when the polypeptide folds into the native protein/antigen (Sela, (1969) Science 166, 1365 and Layer, (1990) Cell 61, 553-6). The two or more discrete amino acid residues contributing to the epitope are present on separate sections of one or more polypeptide chain(s). These residues come together on the surface of the molecule when the polypeptide chain(s) fold(s) into a three-dimensional structure to constitute the epitope. In contrast, a continuous or linear epitope consists of two or more discrete amino acid residues, which are present in a single linear segment of a polypeptide chain. Within the present invention, a "context-dependent" CD3 epitope refers to the conformation of said epitope. Such a context-dependent epitope, localized on the epsilon chain of CD3, can only develop its correct conformation if it is embedded within the rest of the epsilon chain and held in the right position by heterodimerization of the epsilon chain with either CD3 gamma or delta chain. In contrast, a context-independent CD3 epitope as provided herein refers to an N-terminal 1-27 amino acid residue polypeptide or a functional fragment thereof of CD3 epsilon. This N-terminal 1-27 amino acid residue polypeptide or a functional fragment thereof maintains its three-dimensional structural integrity and correct conformation when taken out of its native environment in the CD3 complex. The context-independency of the N-terminal 1-27 amino acid residue polypeptide or a functional fragment thereof, which is part of the extracellular domain of CD3 epsilon, represents, thus, an epitope which is completely different to the epitopes of CD3 epsilon described in connection with a method for the preparation of human binding molecules in WO 2004/106380. Said method used solely expressed recombinant CD3 epsilon. The conformation of this solely expressed recombinant CD3 epsilon differed from that adopted in its natural form, that is, the form in which the CD3 epsilon subunit of the TCR/CD3 complex exists as part of a non-covalent complex with either the CD3 delta or the CD3-gamma subunit of the TCR/CD3 complex. When such solely expressed recombinant CD3 epsilon protein is used as an antigen for selection of antibodies from an antibody library, antibodies specific for this antigen are identified from the library although such a library does not contain antibodies with specificity for self-antigens/autoantigens. This is due to the fact that solely expressed recombinant CD3 epsilon protein does not exist in vivo; it is not an autoantigen. Consequently, subpopulations of B cells expressing antibodies specific for this protein have not been depleted in vivo; an antibody library constructed from such B cells would contain genetic material for antibodies specific for solely expressed recombinant CD3 epsilon protein.

However, since the context-independent N-terminal 1-27 amino acid residue polypeptide or a functional fragment thereof is an epitope, which folds in its native form, binding domains in line with the present invention cannot be identified by methods based on the approach described in WO 2004/106380. Therefore, it could be verified in tests that binding molecules as disclosed in WO 2004/106380 are not capable of binding to the N-terminal 1-27 amino acid residues of the CD3 epsilon chain. Hence, conventional anti-CD3 binding molecules or anti-CD3 antibody molecules (e.g. as disclosed in WO 99/54440) bind CD3 epsilon chain at a position which is more C-terminally located than the context-independent N-terminal 1-27 amino acid residue polypeptide or a functional fragment provided herein. Prior art antibody molecules OKT3 and UCHT-1 have also a specificity for the epsilon-subunit of the TCR/CD3 complex between amino acid residues 35 to 85 and, accordingly, the epitope of these antibodies is also more C-terminally located. In addition, UCHT-1 binds to the CD3 epsilon chain in a region between amino acid residues 43 to 77 (Tunnacliffe, Int. Immunol. 1 (1989), 546-50; Kjer-Nielsen, PNAS 101, (2004), 7675-7680; Salmeron, J. Immunol. 147 (1991), 3047-52). Therefore, prior art anti-CD3 molecules do not bind to and are not directed against the herein defined context-independent N-terminal 1-27 amino acid residue epitope (or a functional fragment thereof). In particular, the state of the art fails to provide anti-CD3 molecules which specifically binds to the context-independent N-terminal 1-27 amino acid residue epitope and which are cross-species specific, i.e. bind to human and non-chimpanzee primate CD3 epsilon.

For the generation of a, preferably human, binding domain comprised in a bispecific single chain antibody molecule of the invention, e.g. monoclonal antibodies binding to both the human and non-chimpanzee primate CD3 epsilon (e.g. macaque CD3 epsilon) or monoclonal antibodies binding to both the human and non-chimpanzee primate PSMA can be used.

As used herein, "human" and "man" refers to the species Homo sapiens. As far as the medical uses of the constructs described herein are concerned, human patients are to be treated with the same molecule.

It is preferred that at least one of said first or second binding domains of the bispecific single chain antibody of the invention is CDR-grafted, humanized or human. Preferably, both the first and second binding domains of the bispecific single chain antibody of the invention are CDR-grafted, humanized or human.

The term "human" antibody as used herein is to be understood as meaning that the bispecific single chain antibody as defined herein, comprises (an) amino acid sequence(s) contained in the human germline antibody repertoire. For the purposes of definition herein, said bispecific single chain antibody may therefore be considered human if it consists of such (a) human germline amino acid sequence(s), i.e. if the amino acid sequence(s) of the bispecific single chain antibody in question is (are) identical to (an) expressed human germline amino acid sequence(s). A bispecific single chain antibody as defined herein may also be regarded as human if it consists of (a) sequence(s) that deviate(s) from its (their) closest human germline sequence(s) by no more than would be expected due to the imprint of somatic hypermutation. Additionally, the antibodies of many non-human mammals, for example rodents such as mice and rats, comprise VH CDR3 amino acid sequences which one may expect to exist in the expressed human antibody repertoire as well. Any such sequence(s) of human or non-human origin which may be expected to exist in the expressed human repertoire would also be considered "human" for the purposes of the present invention.

As used herein, the term "humanized", "humanization", "human-like" or grammatically related variants thereof are used interchangeably to refer to a bispecific single chain antibody comprising in at least one of its binding domains at least one complementarity determining region ("CDR") from a non-human antibody or fragment thereof. Humanization approaches are described for example in WO 91/09968 and U.S. Pat. No. 6,407,213. As non-limiting examples, the term encompasses the case in which a variable region of at least one binding domain comprises a single CDR region, for example the third CDR region of the VH (CDRH3), from another non-human animal, for example a rodent, as well as the case in which a or both variable region/s comprise at each of their respective first, second and third CDRs the CDRs from said non-human animal. In the event that all CDRs of a binding domain of the bispecific single chain antibody have been replaced by their corresponding equivalents from, for example, a rodent, one typically speaks of "CDR-grafting", and this term is to be understood as being encompassed by the term "humanized" or grammatically related variants thereof as used herein. The term "humanized" or grammatically related variants thereof also encompasses cases in which, in addition to replacement of one or more CDR regions within a VH and/or VL of the first and/or second binding domain further mutation/s (e.g. substitutions) of at least one single amino acid residue/s within the framework ("FR") regions between the CDRs has/have been effected such that the amino acids at that/ those positions correspond/s to the amino acid/s at that/those position/s in the animal from which the CDR regions used for replacement is/are derived. As is known in the art, such individual mutations are often made in the framework regions following CDR-grafting in order to restore the original binding affinity of the non-human antibody used as a CDR-donor for its target molecule. The term "humanized" may further encompass (an) amino acid substitution(s) in the CDR regions from a non-human animal to the amino acid(s) of a corresponding CDR region from a human antibody, in addition to the amino acid substitutions in the framework regions as described above.

As used herein, the term "homolog" or "homology" is to be understood as follows: Homology among proteins and DNA is often concluded on the basis of sequence similarity, especially in bioinformatics. For example, in general, if two or more genes have highly similar DNA sequences, it is likely that they are homologous. But sequence similarity may arise from different ancestors: short sequences may be similar by chance, and sequences may be similar because both were selected to bind to a particular protein, such as a transcription factor. Such sequences are similar but not homologous. Sequence regions that are homologous are also called conserved. This is not to be confused with conservation in amino acid sequences in which the amino acid at a specific position has changed but the physio-chemical properties of the amino acid remain unchanged. Homologous sequences are of two types: orthologous and paralogous. Homologous sequences are orthologous if they were separated by a speciation event: when a species diverges into two separate species, the divergent copies of a single gene in the resulting species are said to be orthologous. Orthologs, or orthologous genes, are genes in different species that are similar to each other because they originated from a common ancestor. The strongest evidence that two similar genes are orthologous is the result of a phylogenetic analysis of the gene lineage. Genes that are found within one clade are orthologs, descended from a common ancestor. Orthologs often, but not always, have the same function. Orthologous sequences provide useful information in taxonomic classification studies of organisms. The pattern of genetic divergence can be used to trace the relatedness of organisms. Two organisms that are very closely related are likely to display very similar DNA sequences between two orthologs. Conversely, an organism that is further removed evolutionarily from another organism is likely to display a greater divergence in the sequence of the orthologs being studied. Homologous sequences are paralogous if they were separated by a gene duplication event: if a gene in an organism is duplicated to occupy two different positions in the same genome, then the two copies are paralogous. A set of sequences that are paralogous are called paralogs of each other. Paralogs typically have the same or similar function, but sometimes do not: due to lack of the original selective pressure upon one copy of the duplicated gene, this copy is free to mutate and acquire new functions. An example can be found in rodents such as rats and mice. Rodents have a pair of paralogous insulin genes, although it is unclear if any divergence in function has occurred. Paralogous genes often belong to the same species, but this is not necessary: for example, the hemoglobin gene of humans and the myoglobin gene of chimpanzees are paralogs. This is a common problem in bioinformatics: when genomes of different species have been sequenced and homologous genes have been found, one can not immediately conclude that these genes have the same or similar function, as they could be paralogs whose function has diverged.

As used herein, a "non-chimpanzee primate" or "non-chimp primate" or grammatical variants thereof refers to any primate animal (i.e. not human) other than chimpanzee, i.e. other than an animal of belonging to the genus *Pan*, and including the species *Pan paniscus* and *Pan troglodytes*, also known as *Anthropopithecus troglodytes* or *Simia satyrus*. It will be understood, however, that it is possible that the antibodies of the invention can also bind with their first and/or second binding domain to the respective epitopes/fragments etc. of said chimpanzees. The intention is merely to avoid animal tests which are carried out with chimpanzees, if desired. It is thus also envisaged that in another embodiment the antibodies of the present invention also bind with their first and/or second binding domain to the respective epitopes of chimpanzees. A "primate", "primate species", "primates" or grammatical variants thereof denote/s an order of eutherian mammals divided into the two suborders of prosimians and anthropoids and comprising apes, monkeys and lemurs. Specifically, "primates" as used herein comprises the suborder *Strepsirrhini* (non-tarsier prosimians), including the infraorder Lemuriformes (itself including the superfamilies Chemogaleoidea and Lemuroidea), the infraorder Chiromyiformes (itself including the family Daubentoniidae) and the infraorder Lorisiformes (itself including the families Lorisidae and Galagidae). "Primates" as used herein also comprises the suborder Haplorrhini, including the infraorder Tarsiiformes (itself including the family Tarsiidae), the infraorder Simiiformes (itself including the Platyrrhini, or New-World monkeys, and the Catarrhini, including the Cercopithecidea, or Old-World Monkeys).

The non-chimpanzee primate species may be understood within the meaning of the invention to be a lemur, a tarsier, a gibbon, a marmoset (belonging to New-World Monkeys of the family Cebidae) or an Old-World Monkey (belonging to the superfamily Cercopithecoidea).

As used herein, an "Old-World Monkey" comprises any monkey falling in the superfamily Cercopithecoidea, itself subdivided into the families: the Cercopithecinae, which are mainly African but include the diverse genus of macaques which are Asian and North African; and the Colobinae, which include most of the Asian genera but also the African colobus monkeys.

Specifically, within the subfamily Cercopithecinae, an advantageous non-chimpanzee primate may be from the Tribe Cercopithecini, within the genus *Allenopithecus* (Allen's Swamp Monkey, *Allenopithecus nigroviridis*); within the genus *Miopithecus* (Angolan Talapoin, *Miopithecus talapoin*; Gabon Talapoin, *Miopithecus ogouensis*); within the genus *Erythrocebus* (Patas Monkey, *Erythrocebus patas*); within the genus *Chlorocebus* (Green Monkey, *Chlorocebus sabaceus*; Grivet, *Chlorocebus aethiops*; Bale Mountains Vervet, *Chlorocebus djamdjamensis*; Tantalus Monkey, *Chlorocebus tantalus*; Vervet Monkey, *Chlorocebus pygerythrus*; Malbrouck, *Chlorocebus cynosuros*); or within the genus *Cercopithecus* (Dryas Monkey or Salongo Monkey, *Cercopithecus dryas*; Diana Monkey, *Cercopithecus diana*; Roloway Monkey, *Cercopithecus roloway*; Greater Spot-nosed Monkey, *Cercopithecus nictitans*; Blue Monkey, *Cercopithecus mitis*; Silver Monkey, *Cercopithecus doggetti*; Golden Monkey, *Cercopithecus kandti*; Sykes's Monkey, *Cercopithecus albogularis*; Mona Monkey, *Cercopithecus mona*; Campbell's Mona Monkey, *Cercopithecus campbelli*; Lowe's Mona Monkey, *Cercopithecus lowei*; Crested Mona Monkey, *Cercopithecus pogonias*; Wolf's Mona Monkey, *Cercopithecus wolfi*; Dent's Mona Monkey, *Cercopithecus denti*; Lesser Spot-nosed Monkey, *Cercopithecus petaurista*; White-throated Guenon, *Cercopithecus erythrogaster*; Sclater's Guenon, *Cercopithecus sclateri*; Red-eared Guenon, *Cercopithecus erythrotis*; Moustached Guenon, *Cercopithecus cephus*; Red-tailed Monkey, *Cercopithecus ascanius*; L'Hoest's Monkey, *Cercopithecus lhoesti*; Preuss's Monkey, *Cercopithecus preussi*; Sun-tailed Monkey, *Cercopithecus solatus*; Hamlyn's Monkey or Owl-faced Monkey, *Cercopithecus hamlyni*; De Brazza's Monkey, *Cercopithecus neglectus*). Alternatively, an advantageous non-chimpanzee primate, also within the subfamily Cercopithecinae but within the Tribe Papionini, may be from within the genus *Macaca* (Barbary Macaque, *Macaca sylvanus*; Lion-tailed Macaque, *Macaca silenus*; Southern Pig-tailed Macaque or Beruk, *Macaca nemestrina*; Northern Pig-tailed Macaque, *Macaca leonina*; Pagai Island Macaque or Bokkoi, *Macaca pagensis*; Siberut Macaque, *Macaca siberu*; Moor Macaque, *Macaca maura*; Booted Macaque, *Macaca ochreata*; Tonkean Macaque, *Macaca tonkeana*; Heck's Macaque, *Macaca hecki*; Gorontalo Macaque, *Macaca nigriscens*; Celebes Crested Macaque or Black "Ape", *Macaca nigra*; Cynomolgus monkey or Crab-eating Macaque or Long-tailed Macaque or Kera, *Macaca fascicularis*; Stump-tailed Macaque or Bear Macaque, *Macaca arctoides*; Rhesus Macaque, *Macaca mulatta*; Formosan Rock Macaque, *Macaca cyclopis*; Japanese Macaque, *Macaca fuscata*; Toque Macaque, *Macaca sinica*; Bonnet Macaque, *Macaca radiata*; Barbary Macaque, *Macaca sylvanmus*; Assam Macaque, *Macaca assamensis*; Tibetan Macaque or Milne-Edwards' Macaque, *Macaca thibetana*; Arunachal Macaque or Munzala, *Macaca munzala*); within the genus *Lophocebus* (Gray-cheeked Mangabey, *Lophocebus albigena; Lophocebus albigena albigena; Lophocebus albigena osmani; Lophocebus albigena johnstoni*; Black Crested Mangabey, *Lophocebus aterrimus*; Opdenbosch's Mangabey, *Lophocebus opdenboschi*; Highland Mangabey, *Lophocebus kipunji*); within the genus *Papio* (Hamadryas Baboon, *Papio hamadryas*; Guinea Baboon, *Papio papio*; Olive Baboon, *Papio anubis*; Yellow Baboon, *Papio cynocephalus*; Chacma Baboon, *Papio ursinus*); within the genus *Theropithecus* (Gelada, *Theropithecus gelada*); within the genus *Cercocebus* (Sooty Mangabey, *Cercocebus atys; Cercocebus atys atys; Cercocebus atys lunulatus*; Collared Mangabey, *Cercocebus torquatus*; Agile Mangabey, *Cercocebus agilis*; Golden-bellied Mangabey, *Cercocebus chrysogaster*; Tana River Mangabey, *Cercocebus galeritus*; Sanje Mangabey, *Cercocebus sanjei*); or within the genus *Mandrillus* (Mandrill, *Mandrillus sphinx*; Drill, *Mandrillus leucophaeus*). Most preferred is *Macaca fascicularis* (also known as Cynomolgus monkey and, therefore, in the Examples named "Cynomolgus") and *Macaca mulatta* (rhesus monkey, named "rhesus").

Within the subfamily Colobinae, an advantageous non-chimpanzee primate may be from the African group, within the genus *Colobus* (Black Colobus, *Colobus satanas*; Angola Colobus, *Colobus angolensis*; King Colobus, *Colobus polykomos*; Ursine Colobus, *Colobus vellerosus*; Mantled Guereza, *Colobus guereza*); within the genus *Piliocolobus* (Western Red Colobus, *Piliocolobus badius; Piliocolobus badius badius; Piliocolobus badius temminckii; Piliocolobus badius waldronae*; Pennant's Colobus, *Piliocolobus pennantii; Piliocolobus pennantii pennantii; Piliocolobus pennantii epieni; Piliocolobus pennantii bouvieri*; Preuss's Red Colobus, *Piliocolobus preussi*; Thollon's Red Colobus, *Piliocolobus tholloni*; Central African Red Colobus, *Piliocolobus foai; Piliocolobus foai foai; Piliocolobus foai ellioti; Piliocolobus foai oustaleti; Piliocolobus foai semlikiensis; Piliocolobus foai parmentierorum*; Ugandan Red Colobus, *Piliocolobus tephrosceles*; Uzyngwa Red Colobus, *Piliocolobus gordonorum*; Zanzibar Red Colobus, *Piliocolobus kirkii*; Tana River Red Colobus, *Piliocolobus rufomitratus*); or within the genus *Procolobus* (Olive Colobus, *Procolobus verus*). Within the subfamily Colobinae, an advantageous non-chimpanzee primate may alternatively be from the Langur (leaf monkey) group, within the genus *Semnopithecus* (Nepal Gray Langur, *Semnopithecus schistaceus*; Kashmir Gray Langur, *Semnopithecus ajax*; Tarai Gray Langur, *Semnopithecus hector*; Northern Plains Gray Langur, *Semnopithecus entellus*; Black-footed Gray Langur, *Semnopithecus hypoleucos*; Southern Plains Gray Langur, *Semnopithecus dussumieri*; Tufted Gray Langur, *Semnopithecus priam*); within the *T. vetulus* group or the genus *Trachypithecus* (Purple-faced Langur, *Trachypithecus vetulus*; Nilgiri Langur, *Trachypithecus johnii*); within the *T. cristatus* group of the genus *Trachypithecus* (Javan Lutung, *Trachypithecus auratus*; Silvery Leaf Monkey or Silvery Lutung, *Trachypithecus cristatus*; Indochinese Lutung, *Trachypithecus germaini*; Tenasserim Lutung, *Trachypithecus barbei*); within the *T. obscurus* group of the genus *Trachypithecus* (Dusky Leaf Monkey or Spectacled Leaf Monkey, *Trachypithecus obscurus*; Phayre's Leaf Monkey, *Trachypithecus phayrei*); within the *T. pileatus* group of the genus *Trachypithecus* (Capped Langur, *Trachypithecus pileatus*; Shortridge's Langur, *Trachypithecus shortridgei*; Gee's Golden Langur, *Trachypithecus geei*); within the *T. francoisi* group of the genus *Trachypithecus* (Francois' Langur, *Trachypithecus francoisi*; Hatinh Langur, *Trachypithecus hatinhensis*; White-headed Langur, *Trachypithecus poliocephalus*; Laotian Langur, *Trachypithecus laotum*; Delacour's Langur, *Trachypithecus delacouri*; Indochinese Black Langur, *Trachypithecus ebenus*); or within the genus *Presbytis* (Sumatran Surili, *Presbytis melalophos*; Banded Surili, *Presbytis femoralis*; Sarawak Surili, *Presbytis chrysomelas*; White-thighed Surili, *Presbytis siamensis*; White-fronted Surili, *Presbytis frontata*; Javan Surili, *Presbytis comata*; Thomas's Langur, *Presbytis thomasi*; Hose's Langur, *Presbytis hosei*; Maroon Leaf Monkey, *Presbytis rubicunda*; Mentawai Langur or Joja, *Presbytis potenziani*; Natuna Island Surili, *Presbytis natunae*).

Within the subfamily Colobinae, an advantageous non-chimpanzee primate may alternatively be from the Odd-Nosed group, within the genus *Pygathrix* (Red-shanked Douc, *Pygathrix nemaeus*; Black-shanked Douc, *Pygathrix nigripes*; Gray-shanked Douc, *Pygathrix cinerea*); within the genus *Rhinopithecus* (Golden Snub-nosed Monkey, *Rhinopithecus roxellana*; Black Snub-nosed Monkey, *Rhinopithecus bieti*; Gray Snub-nosed Monkey, *Rhinopithecus brelichi*; Tonkin Snub-nosed Langur, *Rhinopithecus avunculus*); within the genus *Nasalis* (Proboscis Monkey, *Nasalis larvatus*); or within the genus *Simias* (Pig-tailed Langur, *Simias concolor*).

As used herein, the term "marmoset" denotes any New-World Monkeys of the genus *Callithrix*, for example belonging to the Atlantic marmosets of subgenus *Callithrix* (sic!) (Common Marmoset, *Callithrix (Callithrix) jacchus*; Black-tufted Marmoset, *Callithrix (Callithrix) penicillata*; Wied's Marmoset, *Callithrix (Callithrix) kuhlii*; White-headed Marmoset, *Callithrix (Callithrix) geoffroyi*; Buffy-headed Marmoset, *Callithrix (Callithrix) flaviceps*; Buffy-tufted Marmoset, *Callithrix (Callithrix) aurita*); belonging to the Amazonian marmosets of subgenus *Mico* (Rio Acari Marmoset, *Callithrix (Mico) acariensis*; Manicore Marmoset, *Callithrix (Mico) manicorensis*; Silvery Marmoset, *Callithrix (Mico) argentata*; White Marmoset, *Callithrix (Mico) leucippe*; Emilia's Marmoset, *Callithrix (Mico) emiliae*; Black-headed Marmoset, *Callithrix (Mico) nigriceps*; Marca's Marmoset, *Callithrix (Mico)marcai*; Black-tailed Marmoset, *Callithrix (Mico) melanura*; Santarem Marmoset, *Callithrix (Mico) humeralifera*; Maués Marmoset, *Callithrix (Mico) mauesi*; Gold-and-white Marmoset, *Callithrix (Mico) chrysoleuca*; Hershkovitz's Marmoset, *Callithrix (Mico) intermedia*; Satéré Marmoset, *Callithrix (Mico) saterei*); Roosmalens' Dwarf Marmoset belonging to the subgenus *Callibella* (*Callithrix (Callibella) humilis*); or the Pygmy Marmoset belonging to the subgenus *Cebuella* (*Callithrix (Cebuella) pygmaea*).

Other genera of the New-World Monkeys comprise tamarins of the genus *Saguinus* (comprising the *S. oedipus*-group, the *S. midas* group, the *S. nigricollis* group, the *S. mystax* group, the *S. bicolor* group and the *S. inustus* group) and squirrel monkeys of the genus *Samiri* (e.g. *Saimiri sciureus, Saimiri oerstedii, Saimiri ustus, Saimiri boliviensis, Saimiri vanzolini*)

In a preferred embodiment of the bispecific single chain antibody molecule of the invention, the non-chimpanzee primate is an old world monkey. In a more preferred embodiment of the polypeptide, the old world monkey is a monkey of the *Papio* genus *Macaque* genus. Most preferably, the monkey of the *Macaque* genus is Assamese macaque (*Macaca assamensis*), Barbary macaque (*Macaca sylvanus*), Bonnet macaque (*Macaca radiata*), Booted or Sulawesi-Booted macaque (*Macaca ochreata*), Sulawesi-crested macaque (*Macaca nigra*), Formosan rock macaque (*Macaca cyclopsis*), Japanese snow macaque or Japanese macaque (*Macaca fuscata*), Cynomologus monkey or crab-eating macaque or long-tailed macaque or Java macaque (*Macaca fascicularis*), Lion-tailed macaque (*Macaca silenus*), Pigtailed macaque (*Macaca nemestrina*), Rhesus macaque (*Macaca mulatta*), Tibetan macaque (*Macaca thibetana*), Tonkean macaque (*Macaca tonkeana*), Toque macaque (*Macaca sinica*), Stump-tailed macaque or Red-faced macaque or Bear monkey (*Macaca arctoides*), or Moor macaque (*Macaca maurus*). Most preferably, the monkey of the *Papio* genus is Hamadryas Baboon, *Papio hamadryas*; Guinea Baboon, *Papio papio*; Olive Baboon, *Papio anubis*; Yellow Baboon, *Papio cynocephalus*; Chacma Baboon, *Papio ursinus*.

In an alternatively preferred embodiment of the bispecific single chain antibody molecule of the invention, the non-chimpanzee primate is a new world monkey. In a more preferred embodiment of the polypeptide, the new world monkey is a monkey of the *Callithrix* genus (marmoset), the *Saguinus* genus or the *Samiri* genus. Most preferably, the monkey of the *Callithrix* genus is *Callithrix jacchus*, the monkey of the *Saguinus* genus is *Saguinus oedipus* and the monkey of the *Samiri* genus is *Saimiri sciureus*.

The term "cell surface antigen" as used herein denotes a molecule, which is displayed on the surface of a cell. In most cases, this molecule will be located in or on the plasma membrane of the cell such that at least part of this molecule remains accessible from outside the cell in tertiary form. A non-limiting example of a cell surface molecule, which is located in the plasma membrane is a transmembrane protein comprising, in its tertiary conformation, regions of hydrophilicity and hydrophobicity. Here, at least one hydrophobic region allows the cell surface molecule to be embedded, or inserted in the hydrophobic plasma membrane of the cell while the hydrophilic regions extend on either side of the plasma membrane into the cytoplasm and extracellular space, respectively. Non-limiting examples of cell surface molecules which are located on the plasma membrane are proteins which have been modified at a cysteine residue to bear a palmitoyl group, proteins modified at a C-terminal cysteine residue to bear a farnesyl group or proteins which have been modified at the C-terminus to bear a glycosyl phosphatidyl inositol ("GPI") anchor. These groups allow covalent attachment of proteins to the outer surface of the plasma membrane, where they remain accessible for recognition by extracellular molecules such as antibodies. Examples of cell surface antigens are CD3 epsilon and PSMA. As described herein above, PSMA is a cell surface antigen which is a target for therapy of cancer, including, but not limited to solid tumors, preferably carcinomas and prostate cancer.

In light of this, PSMA can also be characterized as a tumor antigen. The term "tumor antigen" as used herein may be understood as those antigens that are presented on tumor cells. These antigens can be presented on the cell surface with an extracellular part, which is often combined with a transmembrane and cytoplasmic part of the molecule. These antigens can sometimes be presented only by tumor cells and never by the normal ones. Tumor antigens can be exclusively expressed on tumor cells or might represent a tumor specific mutation compared to normal cells. In this case, they are called tumor-specific antigens. More common are antigens that are presented by tumor cells and normal cells, and they are called tumor-associated antigens. These tumor-associated antigens can be overexpressed compared to normal cells or are accessible for antibody binding in tumor cells due to the less compact structure of the tumor tissue compared to normal tissue. One example for a tumor antigen in line with the present invention is PSMA.

As described herein above the bispecific single chain antibody molecule of the invention binds with the first binding domain to an epitope of human and non-chimpanzee primate CD3ε (epsilon) chain, wherein the epitope is part of an amino acid sequence comprised in the group consisting of 27 amino acid residues as depicted in SEQ ID NOs. 2, 4, 6, or 8 or a functional fragment thereof.

In line with the present invention it is preferred for the bispecific single chain antibody molecule of the invention that said epitope is part of an amino acid sequence comprising 26, 25, 24, 23, 22, 21, 20, 19, 18, 17, 16, 15, 14, 13, 12, 11, 10, 9, 8, 7, 6 or 5 amino acids.

More preferably, wherein said epitope comprises at least the amino acid sequence Gln-Asp-Gly-Asn-Glu (Q-D-G-N-E).

Within the present invention, a functional fragment of the N-terminal 1-27 amino acid residues means that said functional fragment is still a context-independent epitope maintaining its three-dimensional structural integrity when taken out of its native environment in the CD3 complex (and fused to a heterologous amino acid sequence such as EpCAM or an immunoglobulin Fc part, e.g. as shown in Example 3.1 of WO 2008/119567). The maintenance of the three-dimensional structure within the 27 amino acid N-terminal polypeptide or functional fragment thereof of CD3 epsilon can be used for the generation of binding domains which bind to the N-terminal CD3 epsilon polypeptide fragment in vitro and to the native (CD3 epsilon subunit of the) CD3 complex on T cells in vivo with the same binding affinity. Within the present invention, a functional fragment of the N-terminal 1-27 amino acid residues means that CD3 binding domains provided herein can still bind to such functional fragments in a context-independent manner. The person skilled in the art is aware of methods for epitope mapping to determine which amino acid residues of an epitope are recognized by such anti-CD3 binding domains (e.g. alanine scanning; see examples of WO 2008/119567).

In one embodiment of the invention, the bispecific single chain antibody molecule of the invention comprises a (first) binding domain capable of binding to an epitope of human and non-chimpanzee primate CD3ε chain and a second binding domain capable of binding to the cell surface antigen PSMA.

Within the present invention it is further preferred that the second binding domain binds to the human cell surface antigen PSMA and/or a non-chimpanzee primate PSMA. Particularly preferred, the second binding domain binds to the human PSMA and a non-chimpanzee primate PSMA, preferably a macaque PSMA. It is to be understood, that the second binding domain binds to at least one non-chimpanzee primate PSMA, however, it may also bind to two, three or more, non-chimpanzee primate PSMA homologs. For example, the second binding domain may bind to the Cynomolgus monkey PSMA and to the Rhesus monkey PSMA.

The present invention including all methods, uses, kits etc. described herein, also relates to the second binding domains as such (i.e. not in the context of a bispecific single chain antibody). "As such" further includes antibody formats other than the bispecific single chain antibodies as described herein, for example antibody fragments (comprising the second domain), humanized antibodies, fusion proteins comprising the second domain etc. Antibody formats other than the bispecific single chain antibodies of the present invention are also described herein above.

For the generation of the second binding domain of the bispecific single chain antibody molecule of the invention, e.g. bispecific single chain antibodies as defined herein, monoclonal antibodies binding to both of the respective human and/or non-chimpanzee primate cell surface antigen such as PSMA can be utilized. Appropriate binding domains for the bispecific polypeptide as defined herein e.g. can be derived from cross-species specific monoclonal antibodies by recombinant methods described in the art. A monoclonal antibody binding to a human cell surface antigen and to the homolog of said cell surface antigen in a non-chimpanzee primate can be tested by FACS assays as set forth above. It is evident to those skilled in the art that cross-species specific antibodies can also be generated by hybridoma techniques described in the literature (Milstein and Köhler, Nature 256 (1975), 495-7). For example, mice may be alternately immunized with human and non-chimpanzee primate cell surface antigen, such as PSMA. From these mice, cross-species specific antibody-producing hybridoma cells are isolated via hybridoma technology and analysed by FACS as set forth above. The generation and analysis of bispecific polypeptides such as bispecific single chain antibodies exhibiting cross-species specificity as described herein is shown in the following examples. The advantages of the bispecific single chain antibodies exhibiting cross-species specificity include the points enumerated herein.

It is particularly preferred for the bispecific single chain antibody molecule of the invention that the first binding domain capable of binding to an epitope of human and non-chimpanzee primate CD3ε chain comprises a VL region comprising CDR-L1, CDR-L2 and CDR-L3 selected from:
(a) CDR-L1 as depicted in SEQ ID NO. 27, CDR-L2 as depicted in SEQ ID NO. 28 and CDR-L3 as depicted in SEQ ID NO. 29;
(b) CDR-L1 as depicted in SEQ ID NO. 117, CDR-L2 as depicted in SEQ ID NO. 118 and CDR-L3 as depicted in SEQ ID NO. 119; and
(c) CDR-L1 as depicted in SEQ ID NO. 153, CDR-L2 as depicted in SEQ ID NO. 154 and CDR-L3 as depicted in SEQ ID NO. 155.

The variable regions, i.e. the variable light chain ("L" or "VL") and the variable heavy chain ("H" or "VH") are understood in the art to provide the binding domain of an antibody. This variable regions harbor the complementary determining regions.

The term "complementary determining region" (CDR) is well known in the art to dictate the antigen specificity of an antibody. The term "CDR-L" or "L CDR" or "LCDR" refers to CDRs in the VL, whereas the term "CDR-H" or "H CDR" or HCDR" refers to the CDRs in the VH.

In an alternatively preferred embodiment of the bispecific single chain antibody molecule of the invention the first binding domain capable of binding to an epitope of human and non-chimpanzee primate CD3ε chain comprises a VH region comprising CDR-H1, CDR-H2 and CDR-H3 selected from:
(a) CDR-H1 as depicted in SEQ ID NO. 12, CDR-H2 as depicted in SEQ ID NO. 13 and CDR-H3 as depicted in SEQ ID NO. 14;
(b) CDR-H1 as depicted in SEQ ID NO. 30, CDR-H2 as depicted in SEQ ID NO. 31 and CDR-H3 as depicted in SEQ ID NO. 32;
(c) CDR-H1 as depicted in SEQ ID NO. 48, CDR-H2 as depicted in SEQ ID NO. 49 and CDR-H3 as depicted in SEQ ID NO. 50;
(d) CDR-H1 as depicted in SEQ ID NO. 66, CDR-H2 as depicted in SEQ ID NO. 67 and CDR-H3 as depicted in SEQ ID NO. 68;
(e) CDR-H1 as depicted in SEQ ID NO. 84, CDR-H2 as depicted in SEQ ID NO. 85 and CDR-H3 as depicted in SEQ ID NO. 86;
(f) CDR-H1 as depicted in SEQ ID NO. 102, CDR-H2 as depicted in SEQ ID NO. 103 and CDR-H3 as depicted in SEQ ID NO. 104;
(g) CDR-H1 as depicted in SEQ ID NO. 120, CDR-H2 as depicted in SEQ ID NO. 121 and CDR-H3 as depicted in SEQ ID NO. 122;
(h) CDR-H1 as depicted in SEQ ID NO. 138, CDR-H2 as depicted in SEQ ID NO. 139 and CDR-H3 as depicted in SEQ ID NO. 140;
(i) CDR-H1 as depicted in SEQ ID NO. 156, CDR-H2 as depicted in SEQ ID NO. 157 and CDR-H3 as depicted in SEQ ID NO. 158; and
(j) CDR-H1 as depicted in SEQ ID NO. 174, CDR-H2 as depicted in SEQ ID NO. 175 and CDR-H3 as depicted in SEQ ID NO. 176.

It is further preferred that the binding domain capable of binding to an epitope of human and non-chimpanzee primate CD3ε chain comprises a VL region selected from the group consisting of a VL region as depicted in SEQ ID NO. 35, 39, 125, 129, 161 or 165.

It is alternatively preferred that the first binding domain capable of binding to an epitope of human and non-chimpanzee primate CD3ε chain comprises a VH region selected from the group consisting of a VH region as depicted in SEQ ID NO. 15, 19, 33, 37, 51, 55, 69, 73, 87, 91, 105, 109, 123, 127, 141, 145, 159, 163, 177 or 181.

More preferably, the bispecific single chain antibody molecule of the invention is characterized by the first binding domain capable of binding to an epitope of human and non-chimpanzee primate CD3ε chain, which comprises a VL region and a VH region selected from the group consisting of:
(a) a VL region as depicted in SEQ ID NO. 17 or 21 and a VH region as depicted in SEQ ID NO. 15 or 19;
(b) a VL region as depicted in SEQ ID NO. 35 or 39 and a VH region as depicted in SEQ ID NO. 33 or 37;
(c) a VL region as depicted in SEQ ID NO. 53 or 57 and a VH region as depicted in SEQ ID NO. 51 or 55;
(d) a VL region as depicted in SEQ ID NO. 71 or 75 and a VH region as depicted in SEQ ID NO. 69 or 73;
(e) a VL region as depicted in SEQ ID NO. 89 or 93 and a VH region as depicted in SEQ ID NO. 87 or 91;
(f) a VL region as depicted in SEQ ID NO. 107 or 111 and a VH region as depicted in SEQ ID NO. 105 or 109;
(g) a VL region as depicted in SEQ ID NO. 125 or 129 and a VH region as depicted in SEQ ID NO. 123 or 127;
(h) a VL region as depicted in SEQ ID NO. 143 or 147 and a VH region as depicted in SEQ ID NO. 141 or 145;
(i) a VL region as depicted in SEQ ID NO. 161 or 165 and a VH region as depicted in SEQ ID NO. 159 or 163; and
(j) a VL region as depicted in SEQ ID NO. 179 or 183 and a VH region as depicted in SEQ ID NO. 177 or 181.

According to a preferred embodiment of the bispecific single chain antibody molecule of the invention the pairs of VH-regions and VL-regions in the first binding domain binding to CD3 epsilon are in the format of a single chain antibody (scFv). The VH and VL regions are arranged in the order VH-VL or VL-VH. It is preferred that the VH-region is positioned N-terminally to a linker sequence. The VL-region is positioned C-terminally of the linker sequence. Put in other words, the domain arrangement in the CD3 binding domain of the bispecific single chain antibody molecule of the invention is preferably VH-VL, with said CD3 binding domain located C-terminally to the second (cell surface antigen, such as PSMA) binding domain. Preferably the VH-VL comprises or is SEQ ID NO. 185.

A preferred embodiment of the above described bispecific single chain antibody molecule of the invention is characterized by the first binding domain capable of binding to an epitope of human and non-chimpanzee primate CD3ε chain comprising an amino acid sequence selected from the group consisting of SEQ ID NOs: 23, 25, 41, 43, 59, 61, 77, 79, 95, 97, 113, 115, 131, 133, 149, 151, 167, 169, 185 or 187.

The invention further relates to an above described bispecific single chain antibody, wherein the second binding domain binds to the cell surface antigen PSMA. According to a preferred embodiment of the invention an above characterized bispecific single chain antibody molecule comprises a group of the following sequences as CDR H1, CDR H2, CDR H3, CDR L1, CDR L2 and CDR L3 in the second binding domain selected from the group consisting of:
a) CDR H1-3 of SEQ ID NO: 226-228 and CDR L1-3 of SEQ ID NO: 231-233;

b) CDR H1-3 of SEQ ID NO: 240-242 and CDR L1-3 of SEQ ID NO: 245-247;
c) CDR H1-3 of SEQ ID NO: 254-256 and CDR L1-3 of SEQ ID NO: 259-261;
d) CDR H1-3 of SEQ ID NO: 268-270 and CDR L1-3 of SEQ ID NO: 273-275;
e) CDR H1-3 of SEQ ID NO: 618-620 and CDR L1-3 of SEQ ID NO: 623-625;
f) CDR H1-3 of SEQ ID NO: 282-284 and CDR L1-3 of SEQ ID NO: 287-289;
g) CDR H1-3 of SEQ ID NO: 296-298 and CDR L1-3 of SEQ ID NO: 301-303;
h) CDR H1-3 of SEQ ID NO: 310-312 and CDR L1-3 of SEQ ID NO: 315-317;
i) CDR H1-3 of SEQ ID NO: 324-326 and CDR L1-3 of SEQ ID NO: 329-331;
j) CDR H1-3 of SEQ ID NO: 338-340 and CDR L1-3 of SEQ ID NO: 343-345;
k) CDR H1-3 of SEQ ID NO: 352-354 and CDR L1-3 of SEQ ID NO: 357-359;
l) CDR H1-3 of SEQ ID NO: 366-368 and CDR L1-3 of SEQ ID NO: 371-373;
m) CDR H1-3 of SEQ ID NO: 380-382 and CDR L1-3 of SEQ ID NO: 385-387;
n) CDR H1-3 of SEQ ID NO: 394-396 and CDR L1-3 of SEQ ID NO: 399-401;
o) CDR H1-3 of SEQ ID NO: 408-410 and CDR L1-3 of SEQ ID NO: 413-415;
p) CDR H1-3 of SEQ ID NO: 422-424 and CDR L1-3 of SEQ ID NO: 427-429;
q) CDR H1-3 of SEQ ID NO: 436-438 and CDR L1-3 of SEQ ID NO: 441-443;
r) CDR H1-3 of SEQ ID NO: 450-452 and CDR L1-3 of SEQ ID NO: 455-457;
s) CDR H1-3 of SEQ ID NO: 464-466 and CDR L1-3 of SEQ ID NO: 469-471;
t) CDR H1-3 of SEQ ID NO: 478-480 and CDR L1-3 of SEQ ID NO: 483-485;
u) CDR H1-3 of SEQ ID NO: 492-494 and CDR L1-3 of SEQ ID NO: 497-499;
v) CDR H1-3 of SEQ ID NO: 506-508 and CDR L1-3 of SEQ ID NO: 511-513;
w) CDR H1-3 of SEQ ID NO: 520-522 and CDR L1-3 of SEQ ID NO: 525-527;
x) CDR H1-3 of SEQ ID NO: 534-536 and CDR L1-3 of SEQ ID NO: 539-541;
y) CDR H1-3 of SEQ ID NO: 548-550 and CDR L1-3 of SEQ ID NO: 553-555;
z) CDR H1-3 of SEQ ID NO: 562-564 and CDR L1-3 of SEQ ID NO: 567-569;
aa) CDR H1-3 of SEQ ID NO: 576-578 and CDR L1-3 of SEQ ID NO: 581-583;
ab) CDR H1-3 of SEQ ID NO: 590-592 and CDR L1-3 of SEQ ID NO: 595-597; and
ac) CDR H1-3 of SEQ ID NO: 604-606 and CDR L1-3 of SEQ ID NO: 609-611.

A preferred group of bispecific single chain antibody molecule comprises a group of the following sequences as CDR H1, CDR H2, CDR H3, CDR L1, CDR L2 and CDR L3 in the second binding domain selected from the group consisting of:
a) CDR H1-3 of SEQ ID NO: 226-228 and CDR L1-3 of SEQ ID NO: 231-233;
b) CDR H1-3 of SEQ ID NO: 240-242 and CDR L1-3 of SEQ ID NO: 245-247;
c) CDR H1-3 of SEQ ID NO: 254-256 and CDR L1-3 of SEQ ID NO: 259-261;
d) CDR H1-3 of SEQ ID NO: 268-270 and CDR L1-3 of SEQ ID NO: 273-275; and
e) CDR H1-3 of SEQ ID NO: 618-620 and CDR L1-3 of SEQ ID NO: 623-625.

These molecules comprise a second binding domain which binds to the cell surface antigen PSMA consisting of a $V_H$-chain derived from a parent PSMA specific binding molecule and a $V_L$-chain derived from a binding molecule having a specificity for a different antigen, i.e. for the Epithelial cell adhesion molecule (EpCAM) also known as CD326. It has been surprisingly found that binding molecules with this specific combination of a $V_H$-chain derived from a parent PSMA specific binding molecule and a $V_L$-chain derived from a parent EpCAM specific binding molecule exclusively bind to PSMA but not to EpCAM. The binding specificities of this group of PSMA specific binding domains comprised in the bispecific single chain antibody molecule of the invention are described in the appended example 3.

Another preferred group of bispecific single chain antibody molecule comprises a group of the following sequences as CDR H1, CDR H2, CDR H3, CDR L1, CDR L2 and CDR L3 in the second binding domain selected from the group consisting of:
a) CDR H1-3 of SEQ ID NO: 282-284 and CDR L1-3 of SEQ ID NO: 287-289;
b) CDR H1-3 of SEQ ID NO: 296-298 and CDR L1-3 of SEQ ID NO: 301-303;
c) CDR H1-3 of SEQ ID NO: 310-312 and CDR L1-3 of SEQ ID NO: 315-317;
d) CDR H1-3 of SEQ ID NO: 324-326 and CDR L1-3 of SEQ ID NO: 329-331;
e) CDR H1-3 of SEQ ID NO: 338-341 and CDR L1-3 of SEQ ID NO: 343-345;
f) CDR H1-3 of SEQ ID NO: 352-354 and CDR L1-3 of SEQ ID NO: 357-359; and
g) CDR H1-3 of SEQ ID NO: 366-368 and CDR L1-3 of SEQ ID NO: 371-373.

Another also preferred group of bispecific single chain antibody molecule comprises a group of the following sequences as CDR H1, CDR H2, CDR H3, CDR L1, CDR L2 and CDR L3 in the second binding domain selected from the group consisting of:
a) CDR H1-3 of SEQ ID NO: 380-382 and CDR L1-3 of SEQ ID NO: 385-387;
b) CDR H1-3 of SEQ ID NO: 394-396 and CDR L1-3 of SEQ ID NO: 399-401;
c) CDR H1-3 of SEQ ID NO: 408-410 and CDR L1-3 of SEQ ID NO: 413-415;
d) CDR H1-3 of SEQ ID NO: 422-424 and CDR L1-3 of SEQ ID NO: 427-429;
e) CDR H1-3 of SEQ ID NO: 436-438 and CDR L1-3 of SEQ ID NO: 441-443;
f) CDR H1-3 of SEQ ID NO: 450-452 and CDR L1-3 of SEQ ID NO: 455-457;
g) CDR H1-3 of SEQ ID NO: 464-466 and CDR L1-3 of SEQ ID NO: 469-471;
h) CDR H1-3 of SEQ ID NO: 478-480 and CDR L1-3 of SEQ ID NO: 483-485;
i) CDR H1-3 of SEQ ID NO: 492-494 and CDR L1-3 of SEQ ID NO: 497-499;
j) CDR H1-3 of SEQ ID NO: 506-508 and CDR L1-3 of SEQ ID NO: 511-513;
k) CDR H1-3 of SEQ ID NO: 520-522 and CDR L1-3 of SEQ ID NO: 525-527;
L) CDR H1-3 of SEQ ID NO: 534-536 and CDR L1-3 of SEQ ID NO: 539-541;

m) CDR H1-3 of SEQ ID NO: 548-550 and CDR L1-3 of SEQ ID NO: 553-555;
n) CDR H1-3 of SEQ ID NO: 562-564 and CDR L1-3 of SEQ ID NO: 567-569;
o) CDR H1-3 of SEQ ID NO: 576-578 and CDR L1-3 of SEQ ID NO: 581-583;
p) CDR H1-3 of SEQ ID NO: 590-592 and CDR L1-3 of SEQ ID NO: 595-597; and
q) CDR H1-3 of SEQ ID NO: 604-606 and CDR L1-3 of SEQ ID NO: 609-611.

It is preferred for the bispecific single chain antibody molecule of the invention that the second binding domain which binds to the cell surface antigen PSMA comprises a group of the following sequences as $V_H$- and $V_L$-chains in the second binding domain selected from the group consisting of:
a) a $V_H$-chain of SEQ ID NO: 225 and a $V_L$-chain of SEQ ID NO: 230;
b) a $V_H$-chain of SEQ ID NO: 239 and a $V_L$-chain of SEQ ID NO: 244;
c) a $V_H$-chain of SEQ ID NO: 253 and a $V_L$-chain of SEQ ID NO: 258;
d) a $V_H$-chain of SEQ ID NO: 267 and a $V_L$-chain of SEQ ID NO: 272;
e) a $V_H$-chain of SEQ ID NO: 617 and a $V_L$-chain of SEQ ID NO: 622;
f) a $V_H$-chain of SEQ ID NO: 281 and a $V_L$-chain of SEQ ID NO: 286;
g) a $V_H$-chain of SEQ ID NO: 295 and a $V_L$-chain of SEQ ID NO: 300;
h) a $V_H$-chain of SEQ ID NO: 309 and a $V_L$-chain of SEQ ID NO: 314;
i) a $V_H$-chain of SEQ ID NO: 323 and a $V_L$-chain of SEQ ID NO: 328;
j) a $V_H$-chain of SEQ ID NO: 337 and a $V_L$-chain of SEQ ID NO: 342;
k) a $V_H$-chain of SEQ ID NO: 351 and a $V_L$-chain of SEQ ID NO: 356;
l) a $V_H$-chain of SEQ ID NO: 365 and a $V_L$-chain of SEQ ID NO: 370;
m) a $V_H$-chain of SEQ ID NO: 379 and a $V_L$-chain of SEQ ID NO: 384;
n) a $V_H$-chain of SEQ ID NO: 393 and a $V_L$-chain of SEQ ID NO: 398;
o) a $V_H$-chain of SEQ ID NO: 407 and a $V_L$-chain of SEQ ID NO: 412;
p) a $V_H$-chain of SEQ ID NO: 421 and a $V_L$-chain of SEQ ID NO: 426;
q) a $V_H$-chain of SEQ ID NO: 435 and a $V_L$-chain of SEQ ID NO: 440;
r) a $V_H$-chain of SEQ ID NO: 449 and a $V_L$-chain of SEQ ID NO: 454;
s) a $V_H$-chain of SEQ ID NO: 463 and a $V_L$-chain of SEQ ID NO: 468;
t) a $V_H$-chain of SEQ ID NO: 477 and a $V_L$-chain of SEQ ID NO: 482;
u) a $V_H$-chain of SEQ ID NO: 491 and a $V_L$-chain of SEQ ID NO: 496;
v) a $V_H$-chain of SEQ ID NO: 505 and a $V_L$-chain of SEQ ID NO: 510;
w) a $V_H$-chain of SEQ ID NO: 519 and a $V_L$-chain of SEQ ID NO: 524;
x) a $V_H$-chain of SEQ ID NO: 533 and a $V_L$-chain of SEQ ID NO: 538;
y) a $V_H$-chain of SEQ ID NO: 547 and a $V_L$-chain of SEQ ID NO: 552;
z) a $V_H$-chain of SEQ ID NO: 561 and a $V_L$-chain of SEQ ID NO: 566;
aa) a $V_H$-chain of SEQ ID NO: 575 and a $V_L$-chain of SEQ ID NO: 580;
ab) a $V_H$-chain of SEQ ID NO: 589 and a $V_L$-chain of SEQ ID NO: 594; and
ac) a $V_H$-chain of SEQ ID NO: 603 and a $V_L$-chain of SEQ ID NO: 608.

The above $V_H$- and $V_L$-chains are also shown in SEQ ID NOs: 235, 249, 263, 277, 627, 291, 305, 319, 333, 347, 361, 375, 389, 403, 417, 431, 445, 459, 473, 487, 501, 515, 529, 543, 557, 571, 585, 599 and 613, respectively.

The sequences (amino acid sequence and nucleotide sequence) of the corresponding VL- and VH-regions of the second binding domain of the bispecific single chain antibody molecule of the invention as well as of the respective scFvs are shown in the sequence listing.

In the bispecific single chain antibody molecule of the invention the binding domains are arranged in the order VL-VH-VH-VL, VL-VH-VL-VH, VH-VL-VH-VL or VH-VL-VL-VH, as exemplified in the appended examples. Preferably, the binding domains are arranged in the order VH PSMA-VL PSMA-VH CD3-VL CD3 or VL PSMA-VH PSMA-VH CD3-VL CD3.

A particularly preferred embodiment of the invention concerns an above characterized polypeptide, wherein the bispecific single chain antibody molecule comprises a sequence selected from:
(a) an amino acid sequence as depicted in any of SEQ ID NOs: 237, 251, 265, 279, 629, 293, 307, 321, 335, 349, 363, 377, 391, 405, 419, 433, 447, 461, 475, 489, 503, 517, 531, 545, 559, 573, 587, 601 or 615;
(b) an amino acid sequence encoded by a nucleic acid sequence as depicted in any of SEQ ID NOs: 238, 252, 266, 280, 630, 294, 308, 322, 336, 350, 364, 378, 392, 406, 420, 434, 448, 462, 476, 490, 504, 518, 532, 546, 560, 574, 588, 602 or 616.

The invention relates to a bispecific single chain antibody molecule comprising an amino acid sequence as depicted in any of SEQ ID NOs: 237, 251, 265, 279, 629, 293, 307, 321, 335, 349, 363, 377, 391, 405, 419, 433, 447, 461, 475, 489, 503, 517, 531, 545, 559, 573, 587, 601 or 615, as well as to amino acid sequences at least 96% identical, preferably 97%, more preferred at least 98% identical, most preferred at least 99% identical to the amino acid sequence of SEQ ID NOs: 237, 251, 265, 279, 629, 293, 307, 321, 335, 349, 363, 377, 391, 405, 419, 433, 447, 461, 475, 489, 503, 517, 531, 545, 559, 573, 587, 601 or 615. The invention relates also to the corresponding nucleic acid sequences as depicted in any of SEQ ID NOs: 238, 252, 266, 280, 630, 294, 308, 322, 336, 350, 364, 378, 392, 406, 420, 434, 448, 462, 476, 490, 504, 518, 532, 546, 560, 574, 588, 602 or 616 as well as to nucleic acid sequences at least 96% identical, preferably 97%, more preferred at least 98 identical, most preferred at least 99% identical to the nucleic acid sequences shown in SEQ ID NOs: 238, 252, 266, 280, 630, 294, 308, 322, 336, 350, 364, 378, 392, 406, 420, 434, 448, 462, 476, 490, 504, 518, 532, 546, 560, 574, 588, 602 or 616. It is to be understood that the sequence identity is determined over the entire nucleotide or amino acid sequence. For sequence alignments, for example, the programs Gap or BestFit can be used (Needleman and Wunsch J. Mol. Biol. 48 (1970), 443-453; Smith and Waterman, Adv. Appl. Math 2 (1981), 482-489), which is contained in the GCG software package (Genetics Computer Group, 575 Science Drive, Madison, Wis., USA 53711 (1991). It is a routine method for those skilled in the art to determine and identify a nucleotide or amino acid sequence having e.g. 96% (97%, 98% or 99%) sequence identity to the nucleotide or amino acid sequences of the bispecific single chain antibody of the invention by using e.g. one of the above mentioned programs. For example, according to Crick's Wobble hypothesis, the 5' base on the anti-codon is not as spatially confined as the other two bases, and could thus have non-standard base pairing. Put in other words: the third position in a codon triplet may vary so that two triplets which differ in this third position may encode the same amino acid residue. Said hypothesis is well known to the person skilled in the art (see e.g. http colon-slash-slash en.wikipedia.org/wiki/Wobble_Hypothesis; Crick, J Mol Biol 19 (1966): 548-55).

Preferred domain arrangements in the PSMAxCD3 bispecific single chain antibody constructs of the invention are shown in the following examples.

In a preferred embodiment of the invention, the bispecific single chain antibodies are cross-species specific for CD3 epsilon and for the human and non-chimpanzee primate cell surface antigen PSMA, recognized by their second binding domain.

In an alternative embodiment the present invention provides a nucleic acid sequence encoding an above described bispecific single chain antibody molecule of the invention.

The present invention also relates to a vector comprising the nucleic acid molecule of the present invention.

Many suitable vectors are known to those skilled in molecular biology, the choice of which would depend on the function desired and include plasmids, cosmids, viruses, bacteriophages and other vectors used conventionally in genetic engineering. Methods which are well known to those skilled in the art can be used to construct various plasmids and vectors; see, for example, the techniques described in Sambrook et al. (loc cit.) and Ausubel, Current Protocols in Molecular Biology, Green Publishing Associates and Wiley Interscience, N.Y. (1989), (1994). Alternatively, the polynucleotides and vectors of the invention can be reconstituted into liposomes for delivery to target cells. As discussed in further details below, a cloning vector was used to isolate individual sequences of DNA. Relevant sequences can be transferred into expression vectors where expression of a particular polypeptide is required. Typical cloning vectors include pBluescript SK, pGEM, pUC9, pBR322 and pGBT9. Typical expression vectors include pTRE, pCAL-n-EK, pESP-1, pOP13CAT.

Preferably said vector comprises a nucleic acid sequence which is a regulatory sequence operably linked to said nucleic acid sequence defined herein.

The term "regulatory sequence" refers to DNA sequences, which are necessary to effect the expression of coding sequences to which they are ligated. The nature of such control sequences differs depending upon the host organism. In prokaryotes, control sequences generally include promoter, ribosomal binding site, and terminators. In eukaryotes generally control sequences include promoters, terminators and, in some instances, enhancers, transactivators or transcription factors. The term "control sequence" is intended to include, at a minimum, all components the presence of which are necessary for expression, and may also include additional advantageous components.

The term "operably linked" refers to a juxtaposition wherein the components so described are in a relationship permitting them to function in their intended manner. A control sequence "operably linked" to a coding sequence is ligated in such a way that expression of the coding sequence is achieved under conditions compatible with the control sequences. In case the control sequence is a promoter, it is obvious for a skilled person that double-stranded nucleic acid is preferably used.

Thus, the recited vector is preferably an expression vector. An "expression vector" is a construct that can be used to transform a selected host and provides for expression of a coding sequence in the selected host. Expression vectors can for instance be cloning vectors, binary vectors or integrating vectors. Expression comprises transcription of the nucleic acid molecule preferably into a translatable mRNA. Regulatory elements ensuring expression in prokaryotes and/or eukaryotic cells are well known to those skilled in the art. In the case of eukaryotic cells they comprise normally promoters ensuring initiation of transcription and optionally poly-A signals ensuring termination of transcription and stabilization of the transcript. Possible regulatory elements permitting expression in prokaryotic host cells comprise, e.g., the $P_L$, lac, trp or tac promoter in E. coli, and examples of regulatory elements permitting expression in eukaryotic host cells are the AOX1 or GAL1 promoter in yeast or the CMV-, SV40-, RSV-promoter (Rous sarcoma virus), CMV-enhancer, SV40-enhancer or a globin intron in mammalian and other animal cells.

Beside elements, which are responsible for the initiation of transcription such regulatory elements may also comprise transcription termination signals, such as the SV40-poly-A site or the tk-poly-A site, downstream of the polynucleotide. Furthermore, depending on the expression system used leader sequences capable of directing the polypeptide to a cellular compartment or secreting it into the medium may be added to the coding sequence of the recited nucleic acid sequence and are well known in the art; see e.g. WO 2008/119567. The leader sequence(s) is (are) assembled in appropriate phase with translation, initiation and termination sequences, and preferably, a leader sequence capable of directing secretion of translated protein, or a portion thereof, into the periplasmic space or extracellular medium. Optionally, the heterologous sequence can encode a fusion protein including an N-terminal identification peptide imparting desired characteristics, e.g., stabilization or simplified purification of expressed recombinant product; see supra. In this context, suitable expression vectors are known in the art such as Okayama-Berg cDNA expression vector pcDV1 (Pharmacia), pCDM8, pRc/CMV, pcDNA1, pcDNA3 (Invitrogene), pEF-DHFR, pEF-ADA or pEF-neo (Mack et al. PNAS (1995) 92, 7021-7025 and Raum et al. Cancer Immunol Immunother (2001) 50(3), 141-150) or pSPORT1 (GIBCO BRL).

Preferably, the expression control sequences will be eukaryotic promoter systems in vectors capable of transforming of transfecting eukaryotic host cells, but control sequences for prokaryotic hosts may also be used. Once the vector has been incorporated into the appropriate host, the host is maintained under conditions suitable for high level expression of the nucleotide sequences, and as desired, the collection and purification of the bispecific single chain antibody molecule of the invention may follow; see, e.g., the appended examples.

An alternative expression system, which can be used to express a cell cycle interacting protein is an insect system. In one such system, Autographa californica nuclear polyhedrosis virus (AcNPV) is used as a vector to express foreign genes in Spodoptera frugiperda cells or in Trichoplusia larvae. The coding sequence of a recited nucleic acid molecule may be cloned into a nonessential region of the virus, such as the polyhedrin gene, and placed under control of the polyhedrin promoter. Successful insertion of said coding sequence will render the polyhedrin gene inactive and produce recombinant virus lacking coat protein coat. The recombinant viruses are then used to infect *S. frugiperda* cells or *Trichoplusia larvae* in which the protein of the invention is expressed (Smith, J. Virol. 46 (1983), 584; Engelhard, Proc. Nat. Acad. Sci. USA 91 (1994), 3224-3227).

Additional regulatory elements may include transcriptional as well as translational enhancers. Advantageously, the above-described vectors of the invention comprise a selectable and/or scorable marker.

Selectable marker genes useful for the selection of transformed cells and, e.g., plant tissue and plants are well known to those skilled in the art and comprise, for example, antimetabolite resistance as the basis of selection for dhfr, which confers resistance to methotrexate (Reiss, Plant Physiol. (Life Sci. Adv.) 13 (1994), 143-149); npt, which confers resistance to the aminoglycosides neomycin, kanamycin and paromycin (Herrera-Estrella, EMBO J. 2 (1983), 987-995) and hygro, which confers resistance to hygromycin (Marsh, Gene 32 (1984), 481-485). Additional selectable genes have been described, namely trpB, which allows cells to utilize indole in place of tryptophan; hisD, which allows cells to utilize histinol in place of histidine (Hartman, Proc. Natl. Acad. Sci. USA 85 (1988), 8047); mannose-6-phosphate isomerase which allows cells to utilize mannose (WO 94/20627) and ODC (ornithine decarboxylase) which confers resistance to the ornithine decarboxylase inhibitor, 2-(difluoromethyl)-DL-ornithine, DFMO (McConlogue, 1987, In: Current Communications in Molecular Biology, Cold Spring Harbor Laboratory ed.) or deaminase from *Aspergillus terreus* which confers resistance to Blasticidin S (Tamura, Biosci. Biotechnol. Biochem. 59 (1995), 2336-2338).

Useful scorable markers are also known to those skilled in the art and are commercially available. Advantageously, said marker is a gene encoding luciferase (Giacomin, Pl. Sci. 116 (1996), 59-72; Scikantha, J. Bact. 178 (1996), 121), green fluorescent protein (Gerdes, FEBS Lett. 389 (1996), 44-47) or β-glucuronidase (Jefferson, EMBO J. 6 (1987), 3901-3907). This embodiment is particularly useful for simple and rapid screening of cells, tissues and organisms containing a recited vector.

As described above, the recited nucleic acid molecule can be used alone or as part of a vector to express the bispecific single chain antibody molecule of the invention in cells, for, e.g., purification but also for gene therapy purposes. The nucleic acid molecules or vectors containing the DNA sequence(s) encoding any one of the above described bispecific single chain antibody molecule of the invention is introduced into the cells which in turn produce the polypeptide of interest. Gene therapy, which is based on introducing therapeutic genes into cells by ex-vivo or in-vivo techniques is one of the most important applications of gene transfer. Suitable vectors, methods or gene-delivery systems for in-vitro or in-vivo gene therapy are described in the literature and are known to the person skilled in the art; see, e.g., Giordano, Nature Medicine 2 (1996), 534-539; Schaper, Circ. Res. 79 (1996), 911-919; Anderson, Science 256 (1992), 808-813; Verma, Nature 389 (1994), 239; Isner, Lancet 348 (1996), 370-374; Muhlhauser, Circ. Res. 77 (1995), 1077-1086; Onodera, Blood 91 (1998), 30-36; Verma, Gene Ther. 5 (1998), 692-699; Nabel, Ann. N.Y. Acad. Sci. 811 (1997), 289-292; Verzeletti, Hum. Gene Ther. 9 (1998), 2243-51; Wang, Nature Medicine 2 (1996), 714-716; WO 94/29469; WO 97/00957, U.S. Pat. No. 5,580,859; U.S. Pat. No. 5,589,466; or Schaper, Current Opinion in Biotechnology 7 (1996), 635-640; dos Santos Coura and Nardi Virol J. (2007), 4:99. The recited nucleic acid molecules and vectors may be designed for direct introduction or for introduction via liposomes, or viral vectors (e.g., adenoviral, retroviral) into the cell. Preferably, said cell is a germ line cell, embryonic cell, or egg cell or derived there from, most preferably said cell is a stem cell. An example for an embryonic stem cell can be, inter alia, a stem cell as described in Nagy, Proc. Natl. Acad. Sci. USA 90 (1993), 8424-8428.

The invention also provides for a host transformed or transfected with a vector of the invention. Said host may be produced by introducing the above described vector of the invention or the above described nucleic acid molecule of the invention into the host. The presence of at least one vector or at least one nucleic acid molecule in the host may mediate the expression of a gene encoding the above described single chain antibody constructs.

The described nucleic acid molecule or vector of the invention, which is introduced in the host may either integrate into the genome of the host or it may be maintained extrachromosomally.

The host can be any prokaryote or eukaryotic cell.

The term "prokaryote" is meant to include all bacteria, which can be transformed or transfected with DNA or RNA molecules for the expression of a protein of the invention. Prokaryotic hosts may include gram negative as well as gram positive bacteria such as, for example, *E. coli, S. typhimurium, Serratia marcescens* and *Bacillus subtilis*. The term "eukaryotic" is meant to include yeast, higher plant, insect and preferably mammalian cells. Depending upon the host employed in a recombinant production procedure, the protein encoded by the polynucleotide of the present invention may be glycosylated or may be non-glycosylated. Especially preferred is the use of a plasmid or a virus containing the coding sequence of the bispecific single chain antibody molecule of the invention and genetically fused thereto an N-terminal FLAG-tag and/or C-terminal His-tag. Preferably, the length of said FLAG-tag is about 4 to 8 amino acids, most preferably 8 amino acids. An above described polynucleotide can be used to transform or transfect the host using any of the techniques commonly known to those of ordinary skill in the art. Furthermore, methods for preparing fused, operably linked genes and expressing them in, e.g., mammalian cells and bacteria are well-known in the art (Sambrook, loc cit.). Preferably, said host is a bacterium or an insect, fungal, plant or animal cell.

It is particularly envisaged that the recited host may be a mammalian cell. Particularly preferred host cells comprise CHO cells, COS cells, myeloma cell lines like SP2/0 or NS/0. As illustrated in the examples of WO 2008/119567 for other molecules of the same class, particularly preferred are CHO-cells as hosts.

More preferably said host cell is a human cell or human cell line, e.g. per.c6 (Kroos, Biotechnol. Prog., 2003, 19:163-168).

In a further embodiment, the present invention thus relates to a process for the production of a bispecific single chain antibody molecule of the invention, said process comprising culturing a host of the invention under conditions allowing the expression of the bispecific single chain antibody molecule of the invention and recovering the produced polypeptide from the culture.

The transformed hosts can be grown in fermentors and cultured according to techniques known in the art to achieve optimal cell growth. The bispecific single chain antibody molecule of the invention can then be isolated from the growth medium, cellular lysates, or cellular membrane fractions. The isolation and purification of the, e.g., microbially expressed bispecific single chain antibody molecules may be by any conventional means such as, for example, preparative chromatographic separations and immunological separations such as those involving the use of monoclonal or polyclonal antibodies directed, e.g., against a tag of the bispecific single chain antibody molecule of the invention or as described in the appended examples.

The conditions for the culturing of a host, which allow the expression are known in the art to depend on the host system and the expression system/vector used in such process. The parameters to be modified in order to achieve conditions allowing the expression of a recombinant polypeptide are known in the art. Thus, suitable conditions can be determined by the person skilled in the art in the absence of further inventive input.

Once expressed, the bispecific single chain antibody molecule of the invention can be purified according to standard procedures of the art, including ammonium sulfate precipitation, affinity columns, column chromatography, gel electrophoresis and the like; see, Scopes, "Protein Purification", Springer-Verlag, N.Y. (1982). Substantially pure polypeptides of at least about 90 to 95% homogeneity are preferred, and 98 to 99% or more homogeneity are most preferred, for pharmaceutical uses. Once purified, partially or to homogeneity as desired, the bispecific single chain antibody molecule of the invention may then be used therapeutically (including extracorporeally) or in developing and performing assay procedures. Furthermore, examples for methods for the recovery of the bispecific single chain antibody molecule of the invention from a culture are described in detail in the appended examples of WO 2008/119567 for other molecules of the same class. The recovery can also be achieved by a method for the isolation of the bispecific single chain antibody molecule of the invention capable of binding to an epitope of human and non-chimpanzee primate CD3 epsilon (CD3ε□, the method comprising the steps of:
(a) contacting the polypeptide(s) with an N-terminal fragment of the extracellular domain of CD3ε of maximal 27 amino acids comprising the amino acid sequence Gln-Asp-Gly-Asn-Glu-Glu-Met-Gly (SEQ ID NO. 211) or Gln-Asp-Gly-Asn-Glu-Glu-Ile-Gly (SEQ ID NO. 212), fixed via its C-terminus to a solid phase;
(b) eluting the bound polypeptide(s) from said fragment; and
(c) isolating the polypeptide(s) from the eluate of (b).

It is preferred that the polypeptide(s) isolated by the above method of the invention are of human origin.

This method or the isolation of the bispecific single chain antibody molecule of the invention is understood as a method for the isolation of one or more different polypeptides with the same specificity for the fragment of the extracellular domain of CD3ε comprising at its N-terminus the amino acid sequence Gln-Asp-Gly-Asn-Glu-Glu-Met-Gly (SEQ ID NO. 211) or Gln-Asp-Gly-Asn-Glu-Glu-Ile-Gly (SEQ ID NO. 212) from a plurality of polypeptide candidates as well as a method for the purification of a polypeptide from a solution. A non-limiting example for the latter method for the purification of a bispecific single chain antibody molecule from a solution is e.g. the purification of a recombinantly expressed bispecific single chain antibody molecule from a culture supernatant or a preparation from such culture.

As stated above the fragment used in this method is an N-terminal fragment of the extracellular domain of the primate CD3ε molecule. The amino acid sequence of the extracellular domain of the CD3ε molecule of different species is depicted in SEQ ID NOs: 1, 3, 5 and 7. The two forms of the N-terminal octamer are depicted in SEQ ID NOs: 211 and 212. It is preferred that this N-terminus is freely available for binding of the polypeptides to be identified by the method of the invention. The term "freely available" is understood in the context of the invention as free of additional motives such as a His-tag. The interference of such a His-tag with a binding molecule described herein is described in WO 2008/119567.

According to this method said fragment is fixed via its C-terminus to a solid phase.

The person skilled in the art will easily and without any inventive ado elect a suitable solid phase support dependent from the used embodiment of the method of the invention. Examples for a solid support comprise but are not limited to matrices like beads (e.g. agarose beads, sepharose beads, polystyrol beads, dextran beads), plates (culture plates or MultiWell plates) as well as chips known e.g. from Biacore®. The selection of the means and methods for the fixation/immobilization of the fragment to said solid support depend on the election of the solid support. A commonly used method for the fixation/immobilization is a coupling via an N-hydroxysuccinimide (NHS) ester. The chemistry underlying this coupling as well as alternative methods for the fixation/immobilization are known to the person skilled in the art, e.g. from Hermanson "Bioconjugate Techniques", Academic Press, Inc. (1996). For the fixation to/immobilization on chromatographic supports the following means are commonly used: NHS-activated sepharose (e.g. HiTrap-NHS of GE Life Science-Amersham), CnBr-activated sepharose (e.g. GE Life Science-Amersham), NHS-activated dextran beads (Sigma) or activated polymethacrylate. These reagents may also be used in a batch approach. Moreover, dextran beads comprising iron oxide (e.g. available from Miltenyi) may be used in a batch approach. These beads may be used in combination with a magnet for the separation of the beads from a solution. Polypeptides can be immobilized on a Biacore chip (e.g. CM5 chips) by the use of NHS activated carboxymethyldextran. Further examples for an appropriate solid support are amine reactive MultiWell plates (e.g. Nunc Immobilizer™ plates). According to this method said fragment of the extracellular domain of CD3 epsilon can be directly coupled to the solid support or via a stretch of amino acids, which might be a linker or another protein/polypeptide moiety. Alternatively, the extracellular domain of CD3 epsilon can be indirectly coupled via one or more adaptor molecule(s).

Means and methods for the eluation of a peptide or polypeptide bound to an immobilized epitope are well known in the art. The same holds true for methods for the isolation of the identified polypeptide(s) from the eluate.

A method for the isolation of one or more different bispecific single chain antibody molecule(s) with the same specificity for the fragment of the extracellular domain of CD3ε comprising at its N-terminus the amino acid sequence Gln-Asp-Gly-Asn-Glu-Glu-X-Gly (with X being Met or Ile) from a plurality of polypeptide candidates may comprise one or more steps of the following methods for the selection of antigen-specific entities:

CD3ε specific binding domains can be selected from antibody derived repertoires. A phage display library can be constructed based on standard procedures, as for example disclosed in "Phage Display: A Laboratory Manual"; Ed. Barbas, Burton, Scott & Silverman; Cold Spring Harbor Laboratory Press, 2001. The format of the antibody fragments in the antibody library can be scFv, but may generally also be a Fab fragment or even a single domain antibody fragment. For the isolation of antibody fragments naïve antibody fragment libraries may be used. For the selection of potentially low immunogenic binding entities in later therapeutic use, human antibody fragment libraries may be favourable for the direct selection of human antibody fragments. In some cases they may form the basis for synthetic antibody libraries (Knappik et al. J. Mol. Biol. 2000, 296:57 ff). The corresponding format may be Fab, scFv (as described below) or domain antibodies (dAbs, as reviewed in Holt et al., Trends Biotechnol. 2003, 21:484 ff).

It is also known in the art that in many cases there is no immune human antibody source available against the target antigen. Therefore animals are immunized with the target antigen and the respective antibody libraries isolated from animal tissue as e.g. spleen or PBMCs. The N-terminal fragment may be biotinylated or covalently linked to proteins like KLH or bovine serum albumin (BSA). According to common approaches rodents are used for immunization. Some immune antibody repertoires of non-human origin may be especially favourable for other reasons, e.g. for the presence of single domain antibodies (VHH) derived from cameloid species (as described in Muyldermans, J. Biotechnol. 74:277; De Genst et al. Dev Como Immunol. 2006, 30:187 ff). Therefore a corresponding format of the antibody library may be Fab, scFv (as described below) or single domain antibodies (VHH).

In one possible approach ten weeks old F1 mice from balb/c×C57black crossings can be immunized with whole cells e.g. expressing transmembrane EpCAM N-terminally displaying as translational fusion the N-terminal amino acids 1 to 27 of the mature CD3ε chain. Alternatively, mice can be immunized with 1-27 CD3 epsilon-Fc fusion protein (a corresponding approach is described in the examples of WO 2008/119567). After booster immunization(s), blood samples can be taken and antibody serum titer against the CD3-positive T cells can be tested e.g. in FACS analysis. Usually, serum titers are significantly higher in immunized than in non-immunized animals.

Immunized animals may form the basis for the construction of immune antibody libraries. Examples of such libraries comprise phage display libraries. Such libraries may be generally constructed based on standard procedures, as for example disclosed in "Phage Display: A Laboratory Manual"; Ed. Barbas, Burton, Scott & Silverman; Cold Spring Harbor Laboratory Press, 2001.

The non-human antibodies can also be humanized via phage display due to the generation of more variable antibody libraries that can be subsequently enriched for binders during selection.

In a phage display approach any one of the pools of phages that displays the antibody libraries forms a basis to select binding entities using the respective antigen as target molecule. The central step in which antigen specific, antigen bound phages are isolated is designated as panning. Due to the display of the antibody fragments on the surface of the phages, this general method is called phage display. One preferred method of selection is the use of small proteins such as the filamentous phage N2 domain translationally fused to the N-terminus of the scFv displayed by the phage. Another display method known in the art, which may be used to isolate binding entities is the ribosome display method (reviewed in Groves & Osbourn, Expert Opin Biol Ther. 2005, 5:125 ff; Lipovsek & Pluckthun, J Immunol Methods 2004, 290:52 ff). In order to demonstrate binding of scFv phage particles to a 1-27 CD3ε-Fc fusion protein a phage library carrying the cloned scFv-repertoire can be harvested from the respective culture supernatant by PEG (polyethyleneglycole). ScFv phage particles may be incubated with immobilized CD3ε Fc fusion protein. The immobilized CD3ε Fc fusion protein may be coated to a solid phase. Binding entities can be eluted and the eluate can be used for infection of fresh uninfected bacterial hosts. Bacterial hosts successfully transduced with a phagemid copy, encoding a human scFv-fragment, can be selected again for carbenicillin resistance and subsequently infected with e.g. VCMS 13 helper phage to start the second round of antibody display and in vitro selection. A total of 4 to 5 rounds of selections is carried out, normally. The binding of isolated binding entities can be tested on CD3 epsilon positive Jurkat cells, HPBall cells, PBMCs or transfected eukaryotic cells that carry the N-terminal CD3ε sequence fused to surface displayed EpCAM using a flow cytometric assay (see WO 2008/119567).

Preferably, the above method may be a method, wherein the fragment of the extracellular domain of CD3ε consists of one or more fragments of a polypeptide having an amino acid sequence of any one depicted in SEQ ID NOs. 2, 4, 6 or 8. More preferably, said fragment is 8, 9, 10, 11, 12, 13, 14, 15, 16, 17, 18, 19, 20, 21, 22, 23, 24, 25, 26, 27 amino acid residues in length.

This method of identification of a bispecific single chain antibody molecule may be a method of screening a plurality of bispecific single chain antibody molecules comprising a cross-species specific binding domain binding to an epitope of human and non-chimpanzee primate CD3ε. Alternatively, the method of identification is a method of purification/isolation of a bispecific single chain antibody molecule comprising a cross-species specific binding domain binding to an epitope of human and non-chimpanzee primate CD3ε.

Furthermore, the invention provides for a composition comprising a bispecific single chain antibody molecule of the invention or a bispecific single chain antibody as produced by the process disclosed above. Preferably, said composition is a pharmaceutical composition.

The invention provides also for a bispecific single chain antibody molecule as defined herein, or produced according to the process as defined herein, wherein said bispecific single chain antibody molecule is for use in the prevention, treatment or amelioration of cancer. Preferably, said cancer is a solid tumor, more preferably a carcinoma or prostate cancer. It is preferred that the bispecific single chain is further comprising suitable formulations of carriers, stabilizers and/or excipients. Moreover, it is preferred that said bispecific single chain antibody molecule is suitable to be administered in combination with an additional drug. Said drug may be a non-proteinaceous compound or a proteinaceous compound and may be administered simultaneously or non-simultaneously with the bispecific single chain antibody molecule as defined herein.

In accordance with the invention, the term "pharmaceutical composition" relates to a composition for administration to a patient, preferably a human patient. The particular preferred pharmaceutical composition of this invention comprises bispecific single chain antibodies directed against and generated against context-independent CD3 epitopes. Preferably, the pharmaceutical composition comprises suitable formulations of carriers, stabilizers and/or excipients. In a preferred embodiment, the pharmaceutical composition comprises a composition for parenteral, transdermal, intraluminal, intraarterial, intrathecal and/or intranasal administration or by direct injection into tissue. It is in particular envisaged that said composition is administered to a patient via infusion or injection. Administration of the suitable compositions may be effected by different ways, e.g., by intravenous, intraperitoneal, subcutaneous, intramuscular, topical or intradermal administration. In particular, the present invention provides for an uninterrupted administration of the suitable composition. As a non-limiting example, uninterrupted, i.e. continuous administration may be realized by a small pump system worn by the patient for metering the influx of therapeutic agent into the body of the patient. The pharmaceutical composition comprising the bispecific single chain antibodies directed against and generated against context-independent CD3 epitopes of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of these bispecific single chain antibodies directed against and generated against context-independent CD3 epitopes of this invention may be intravenuous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

The composition of the present invention, comprising in particular bispecific single chain antibodies directed against and generated against context-independent CD3 epitopes may further comprise a pharmaceutically acceptable carrier. Examples of suitable pharmaceutical carriers are well known in the art and include solutions, e.g. phosphate buffered saline solutions, water, emulsions, such as oil/water emulsions, various types of wetting agents, sterile solutions, liposomes, etc. Compositions comprising such carriers can be formulated by well known conventional methods. Formulations can comprise carbohydrates, buffer solutions, amino acids and/or surfactants. Carbohydrates may be non-reducing sugars, preferably trehalose, sucrose, octasulfate, sorbitol or xylitol. Such formulations may be used for continuous administrations which may be intravenuous or subcutaneous with and/or without pump systems. Amino acids may be charged amino acids, preferably lysine, lysine acetate, arginine, glutamate and/or histidine. Surfactants may be detergents, preferably with a molecular weight of >1.2 KD and/or a polyether, preferably with a molecular weight of >3 KD. Non-limiting examples for preferred detergents are Tween 20, Tween 40, Tween 60, Tween 80 or Tween 85. Non-limiting examples for preferred polyethers are PEG 3000, PEG 3350, PEG 4000 or PEG 5000. Buffer systems used in the present invention can have a preferred pH of 5-9 and may comprise citrate, succinate, phosphate, histidine and acetate. The compositions of the present invention can be administered to the subject at a suitable dose which can be determined e.g. by dose escalating studies by administration of increasing doses of the bispecific single chain antibody molecule of the invention exhibiting cross-species specificity described herein to non-chimpanzee primates, for instance macaques. As set forth above, the bispecific single chain antibody molecule of the invention exhibiting cross-species specificity described herein can be advantageously used in identical form in preclinical testing in non-chimpanzee primates and as drug in humans. These compositions can also be administered in combination with other proteinaceous and non-proteinaceous drugs. These drugs may be administered simultaneously with the composition comprising the bispecific single chain antibody molecule of the invention as defined herein or separately before or after administration of said polypeptide in timely defined intervals and doses. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently. Preparations for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringer's dextrose, dextrose and sodium chloride, lactated Ringer's, or fixed oils. Intravenous vehicles include fluid and nutrient replenishers, electrolyte replenishers (such as those based on Ringer's dextrose), and the like. Preservatives and other additives may also be present such as, for example, antimicrobials, anti-oxidants, chelating agents, inert gases and the like. In addition, the composition of the present invention might comprise proteinaceous carriers, like, e.g., serum albumin or immunoglobulin, preferably of human origin. It is envisaged that the composition of the invention might comprise, in addition to the bispecific single chain antibody molecule of the invention defined herein, further biologically active agents, depending on the intended use of the composition. Such agents might be drugs acting on the gastro-intestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art.

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Horning S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4):1244]), positron-emission tomography scanning, white blood cell counts, differentials, Fluorescence Activated Cell Sorting, bone marrow aspiration, lymph node biopsies/histologies, and various cancer specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that effect the ability of a particular drug to treat a given condition, is established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above.

"Half-life" means the time where 50% of an administered drug are eliminated through biological processes, e.g. metabolism, excretion, etc.

By "hepatic first-pass metabolism" is meant the propensity of a drug to be metabolized upon first contact with the liver, i.e. during its first pass through the liver.

"Volume of distribution" means the degree of retention of a drug throughout the various compartments of the body, like e.g. intracellular and extracellular spaces, tissues and organs, etc. and the distribution of the drug within these compartments.

"Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered.

"Bioavailability" means the amount of a drug in the blood compartment.

"Lag time" means the time delay between the administration of the drug and its detection and measurability in blood or plasma.

"Tmax" is the time after which maximal blood concentration of the drug is reached, and "Cmax" is the blood concentration maximally obtained with a given drug. The time to reach a blood or tissue concentration of the drug which is required for its biological effect is influenced by all parameters. Pharmacokinetik parameters of bispecific single chain antibodies exhibiting cross-species specificity, which may be determined in preclinical animal testing in non-chimpanzee primates as outlined above are also set forth e.g. in the publication by Schlereth et al. (Cancer Immunol. Immunother. 20 (2005), 1-12).

The term "toxicity" as used herein refers to the toxic effects of a drug manifested in adverse events or severe adverse events. These side events might refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug.

"Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviating to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance haematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The term "effective and non-toxic dose" as used herein refers to a tolerable dose of the bispecific single chain antibody as defined herein which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

Moreover, the invention relates to a pharmaceutical composition comprising a bispecific single chain antibody molecule of this invention or produced according to the process according to the invention for the prevention, treatment or amelioration of cancer. Preferably, said cancer is a solid tumor, preferably a carcinoma or prostate cancer. Preferably, said pharmaceutical composition further comprises suitable formulations of carriers, stabilizers and/or excipients.

A further aspect of the invention relates to a use of a bispecific single chain antibody molecule/polypeptide as defined herein above or produced according to a process defined herein above, for the preparation of a pharmaceutical composition for the prevention, treatment or amelioration of a disease. Preferably, said disease is cancer. More preferably, said cancer is a solid tumor, preferably a carcinoma or prostate cancer.

In another preferred embodiment of use of the bispecific single chain antibody molecule of the invention said pharmaceutical composition is suitable to be administered in combination with an additional drug, i.e. as part of a co-therapy. In said co-therapy, an active agent may be optionally included in the same pharmaceutical composition as the bispecific single chain antibody molecule of the invention, or may be included in a separate pharmaceutical composition. In this latter case, said separate pharmaceutical composition is suitable for administration prior to, simultaneously as or following administration of said pharmaceutical composition comprising the bispecific single chain antibody molecule of the invention. The additional drug or pharmaceutical composition may be a non-proteinaceous compound or a proteinaceous compound. In the case that the additional drug is a proteinaceous compound, it is advantageous that the proteinaceous compound be capable of providing an activation signal for immune effector cells.

Preferably, said proteinaceous compound or non-proteinaceous compound may be administered simultaneously or non-simultaneously with the bispecific single chain antibody molecule of the invention, a nucleic acid molecule as defined hereinabove, a vector as defined as defined hereinabove, or a host as defined as defined hereinabove.

Another aspect of the invention relates to a method for the prevention, treatment or amelioration of a disease in a subject in the need thereof, said method comprising the step of administration of an effective amount of a pharmaceutical composition of the invention. Preferably, said disease is cancer. Preferably, said cancer is a solid tumor, preferably a carcinoma or prostate cancer.

In another preferred embodiment of the method of the invention said pharmaceutical composition is suitable to be administered in combination with an additional drug, i.e. as part of a co-therapy. In said co-therapy, an active agent may be optionally included in the same pharmaceutical composition as the bispecific single chain antibody molecule of the invention, or may be included in a separate pharmaceutical composition. In this latter case, said separate pharmaceutical composition is suitable for administration prior to, simultaneously as or following administration of said pharmaceutical composition comprising the bispecific single chain antibody molecule of the invention. The additional drug or pharmaceutical composition may be a non-proteinaceous compound or a proteinaceous compound. In the case that the additional drug is a proteinaceous compound, it is advantageous that the proteinaceous compound be capable of providing an activation signal for immune effector cells.

Preferably, said proteinaceous compound or non-proteinaceous compound may be administered simultaneously or non-simultaneously with the bispecific single chain antibody molecule of the invention, a nucleic acid molecule as defined hereinabove, a vector as defined as defined hereinabove, or a host as defined as defined hereinabove.

It is preferred for the above described method of the invention that said subject is a human.

In a further aspect, the invention relates to a kit comprising a bispecific single chain antibody molecule of the invention, a nucleic acid molecule of the invention, a vector of the invention, or a host of the invention.

These and other embodiments are disclosed and encompassed by the description and Examples of the present invention. Recombinant techniques and methods in immunology are described e.g. in Sambrook et al. Molecular Cloning: A Laboratory Manual; Cold Spring Harbor Laboratory Press, 3'd edition 2001; Lefkovits; Immunology Methods Manual; The Comprehensive Sourcebook of Techniques; Academic Press, 1997; Golemis; Protein-Protein Interactions: A Molecular Cloning Manual; Cold Spring Laboratory Press, 2002. Further literature concerning any one of the antibodies, methods, uses and compounds to be employed in accordance with the present invention may be retrieved from public libraries and databases, using for example electronic devices. For example, the public database "Medlin", available on the Internet, may be utilized, for example under http colon-slash-slash www.ncbi.nlm.nih.gov/PubMed/medline.html. Further databases and addresses such as http colon-slash-slash www.ncbi.nlm.nih.gov/PubMed/medline.html or listed at the EMBL-services homepage under http colon-slash-slash www.embl.de/services/index.html are known to the person skilled in the art and can also be obtained using, e.g., http colon-slash-slash www.google.com.

The figures show:

FIG. 1

FACS binding analysis of the designated cross-species specific bispecific single chain constructs to CHO cells transfected with the human PSMA, human $CD3^+$ T cell line HPB-ALL, CHO cells transfected with macaque PSMA and a macaque T cell line 4119 LnPx. The FACS staining is performed as described in Example 2.1. The thick line represents cells incubated with cell culture supernatant that are subsequently incubated with the anti-his antibody and the PE labeled detection antibody. The thin histogram line reflects the negative control: cells only incubated with the anti-his antibody and the detection antibody.

FIG. 2:

Cytotoxic activity induced by the designated cross-species specific bispecific single chain constructs redirected to indicated target cell lines. Stimulated $CD4^-/CD56^-$ human T cells are used as effector cells, CHO cells transfected with human PSMA as target cells. The assay is performed as described in Example 2.2.

The present invention is additionally described by way of the following illustrative non-limiting examples that provide a better understanding of the present invention and of its many advantages.

EXAMPLES

1. Generation and Characterization of PSMA and CD3 Cross-Species Specific Bispecific Single Chain Antibody Molecules 1.1 Cloning and Expression of Human PSMA Antigen on CHO Cells The sequence of the human PSMA antigen ('AY101595', *Homo sapiens* prostate-specific membrane antigen mRNA, complete cds, National Center for Biotechnology Information, http://www.ncbi.nlm.nih.gov/entrez) was used to obtain a synthetic molecule by gene synthesis according to standard protocols. The gene synthesis fragment was also designed as to contain a Kozak site for eukaryotic expression of the construct and restriction sites at the beginning and the end of the DNA. The introduced restriction sites XbaI at the 5' end and SalI at the 3' end were utilised during the cloning step into the expression plasmid designated pEFDHFR as described in Mack et al. (Mack M et al., Proc Natl Acad Sci USA 1995; 92:7021-5. and Raum et al. Cancer Immunol Immunother (2001) 50(3)). After sequence verification the plasmid was used to transfect CHO/dhfr-cells as follows. A sequence verified plasmid was used to transfect CHO/dhfr-cells (ATCC No. CRL 9096; cultivated in RPMI 1640 with stabilized glutamine obtained from Biochrom AG Berlin, Germany, supplemented with 10% FCS, 1% penicillin/streptomycin all obtained from Biochrom AG Berlin, Germany and nucleosides from a stock solution of cell culture grade reagents obtained from Sigma-Aldrich Chemie GmbH, Taufkirchen, Germany, to a final concentration of 10 µg/ml Adenosine, 10 µg/ml Deoxyadenosine and 10 µg/ml Thymidine, in an incubator at 37° C., 95% humidity and 7% $CO_2$). Transfection was performed using the PolyFect Transfection Reagent (Qiagen GmbH, Hilden, Germany) and 5 µg of plasmid DNA according to the manufacturer's protocol. After a cultivation of 24 hours cells were washed once with PBS and again cultivated in the aforementioned cell culture medium except that the medium was not supplemented with nucleosides and dialysed FCS (obtained from Biochrom AG Berlin, Germany) was used. Thus the cell culture medium did not contain nucleosides and thereby selection was applied on the transfected cells. Approximately 14 days after transfection the outgrowth of resistant cells was observed. After an additional 7 to 14 days the transfectants were tested positive for expression of the construct via FACS. Eukaryotic protein expression in DHFR deficient CHO cells is performed as described by Kaufmann R. J. (1990) Methods Enzymol. 185, 537-566. Gene amplification of the construct is induced by increasing concentrations of methothrexate (MTX) to a final concentration of up to 20 nM MTX 1.2 Cloning and Expression of Macaque PSMA Antigen on CHO Cells The cDNA sequence of macaque PSMA (cynomolgus) was obtained by a set of five PCRs on cDNA from macaque monkey prostate prepared according to standard protocols. The following reaction conditions: 1 cycle at 94° C. for 2 minutes followed by 40 cycles with 94° C. for 1 minute, 52° C. for 1 minute and 72° C. for 1.5 minutes followed by a terminal cycle of 72° C. for 3 minutes and the following primers were used:

```
forward primer:
                                     (SEQ ID NO. 213)
5'-cactgtggcccaggttcgagg-3'
reverse primer:
                                     (SEQ ID NO. 214)
5'-gacataccacacaaattcaatacgg-3' forward primer:
                                     (SEQ ID NO. 215)
5'-gctctgctcgcgccgagatgtgg-3'
reverse primer:
                                     (SEQ ID NO. 216)
5'-acgctggacaccacctccagg-3' forward primer:
                                     (SEQ ID NO. 217)
5'-ggttctactgagtgggcagagg-3'
reverse primer:
                                     (SEQ ID NO. 218)
5'-acttgttgtggctgcttggagc-3'
```

-continued
```
forward primer:
                                     (SEQ ID NO. 219)
5'-gggtgaagtcctatccagatgg-3'
reverse primer:
                                     (SEQ ID NO. 220)
5'-gtgctctgcctgaagcaattcc-3' forward primer:
                                     (SEQ ID NO. 221)
5'-ctcggcttcctcttcgggtgg-3'
reverse primer:
                                     (SEQ ID NO. 222)
5'-gcatattcatttgctgggtaacctgg-3'
```

These PCRs generated five overlapping fragments, which were isolated and sequenced according to standard protocols using the PCR primers, and thereby provided a portion of the cDNA sequence coding macaque PSMA from codon 3 to the last codon of the mature protein. To generate a construct for expression of macaque PSMA a cDNA fragment was obtained by gene synthesis according to standard protocols (the cDNA and amino acid sequence of the construct is listed under SEQ ID 223 and 224). In this construct the coding sequence of macaque PSMA from amino acid 3 to the last amino acid of the mature PSMA protein followed by a stop codon was fused in frame to the coding sequence of the first two amino acids of the human PSMA protein. The gene synthesis fragment was also designed as to contain a Kozak site for eukaryotic expression of the construct and restriction sites at the beginning and the end of the fragment containing the cDNA. The introduced restriction sites, XbaI at the 5' end and SalI at the 3' end, were utilised in the following cloning procedures. The gene synthesis fragment was cloned via XbaI and SalI into a plasmid designated pEF-DHFR following standard protocols. The aforementioned procedures were carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence was transfected into DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the construct was induced by increasing concentrations of methotrexate (MTX) to a final concentration of up to 20 nM MTX.

Example 2

2.1 Flow Cytometric Binding Analysis of the PSMA and CD3 Cross-Species Specific Bispecific Antibodies In order to test the functionality of the cross-species specific bispecific antibody constructs with regard to binding capability to human and macaque PSMA and to human and macaque CD3, a FACS analysis was performed. For this purpose the CHO cells transfected with human PSMA and human CD3 positive T cell leukemia cell line HPB-ALL (DSMZ, Braunschweig, ACC483) were used to check the binding to human antigens. The binding reactivity to macaque antigens was tested by using the generated macaque PSMA transfectant and a macaque T cell line 4119LnPx (kindly provided by Prof Fickenscher, Hygiene Institute, Virology, Erlangen-Nuernberg; published in Knappe A, et al., and Fickenscher H., Blood 2000, 95, 3256-61).

The flow cytometric analysis was performed as follows: 200.000 cells of the respective cell lines were incubated for 30 min on ice with 50 µl of the purified protein of the cross-species specific bispecific antibody constructs (2 µg/ml) or cell culture supernatant of transfected cells expressing the cross-species specific bispecific antibody constructs. The cells were washed twice in PBS with 2% FCS and binding of the construct was detected with a murine anti-His antibody (Penta H is antibody; Qiagen; diluted 1:20 in 50 µl PBS with 2% FCS). After washing, bound anti-His antibodies were detected with an Fc gamma-specific antibody (Dianova) conjugated to phycoerythrin, diluted 1:100 in PBS with 2% FCS. Supernatant of untransfected CHO cells was used as negative control for binding to the T cell lines. A single chain construct with irrelevant target specificity was used as negative control for binding to the PSMA transfected CHO cells.

Flow cytometry was performed on a FACS-Calibur apparatus; the CellQuest software was used to acquire and analyze the data (Becton Dickinson biosciences, Heidelberg). FACS staining and measuring of the fluorescence intensity were performed as described in Current Protocols in Immunology (Coligan, Kruisbeek, Margulies, Shevach and Strober, Wiley-Interscience, 2002).

The bispecific binding of the single chain molecules, which are cross-species specific for PSMA and cross-species specific for human and macaque CD3 was clearly detectable as shown in FIG. 1. In the FACS analysis all constructs showed binding to CD3 and PSMA as compared to the respective negative controls. Cross-species specificity of the bispecific antibodies to human and macaque CD3 and to human and macaque PSMA antigens was demonstrated.

2.2 Bioactivity of PSMA and CD3 Cross-Species Specific Bispecific Single Chain Antibodies Bioactivity of the generated bispecific single chain antibodies was analyzed by chromium 51 ($^{51}$Cr) release in vitro cytotoxicity assays using human PSMA positive cell line CHO cells. As effector cells stimulated human CD4/CD56 depleted PBMC are used.

Generation of the stimulated CD4/CD56 depleted PBMC was performed as follows: Coating of a Petri dish (145 mm diameter, Greiner bio-one GmbH, Frickenhausen) was carried out with a commercially available anti-CD3 specific antibody (e.g. OKT3, Othoclone) in a final concentration of 1 µg/ml for 1 hour at 37° C. Unbound protein was removed by one washing step with PBS. The fresh PBMC were isolated from peripheral blood (30-50 ml human blood) by Ficoll gradient centrifugation according to standard protocols. 3-5×10$^7$ PBMC were added to the precoated petri dish in 120 ml of RPMI 1640 with stabilized glutamine/10% FCS/IL-2 20 U/ml (Proleukin, Chiron) and stimulated for 2 days. On the third day the cells were collected and washed once with RPMI 1640. IL-2 was added to a final concentration of 20 U/ml and the cells were cultivated again for one day in the same cell culture medium as above. By depletion of CD4+ T cells and CD56+ NK cells according to standard protocols CD8+ cytotoxic T lymphocytes (CTLs) were enriched.

Target cells were washed twice with PBS and labelled with 11.1 MBq $^{51}$Cr in a final volume of 100 µl RPMI with 50% FCS for 45 minutes at 37° C. Subsequently the labelled target cells were washed 3 times with 5 ml RPMI and then used in the cytotoxicity assay. The assay was performed in a 96 well plate in a total volume of 250 µl supplemented RPMI (as above) with an E:T ratio 10:1. 1 µg/ml of the cross-species specific bispecific single chain antibody molecules and 20 threefold dilutions thereof were applied. The assay time was 18 hours and cytotoxicity was measured as relative values of released chromium in the supernatant related to the difference of maximum lysis (addition of Triton-X) and spontaneous lysis (without effector cells). All measurements were done in quadruplicates. Measurement of chromium activity in the supernatants was performed with a Wizard 3" gamma counter (Perkin Elmer Life Sciences GmbH, Köln, Germany). Analysis of the experimental data was performed with Prism 5 for Windows (version 5.01, GraphPad Software Inc., San Diego, Calif., USA). Sigmoidal dose response curves typically have $R^2$ values >0.90 as determined by the software. $EC_{50}$ values calculated by the analysis program were used for comparison of bioactivity.

As shown in FIG. 2, all of the generated cross-species specific bispecific single chain antibody constructs demonstrate cytotoxic activity against human PSMA positive target cells elicited by stimulated human CD4/CD56 depleted PBMC.

Example 3

Binding Analysis of scFvs Against Various Cell Lines

3.1. Expression of Single Chain Antibody Constructs in E. coli

The scFv molecules EpCAM 4-7 (WO 99/25818), PM74-G3, PM52-H3, PM52-C3, PM75-A10 and PM91-B6 are expressed by use of the plasmid pComb3H5BFlag/His wherein the expression constructs (e.g. scFv) include the Flag-tag (DYKDDDDK) and the His6-tag. The plasmid DNA of each scFv molecule is transformed into 100 µl heat shock competent E. coli TG1 and plated onto carbenicillin LB-agar. E. coli transformed with pComb3H5BFlag/His containing a VL- and VH-segment produce soluble scFv in sufficient amounts after induction with 1 mM IPTG. Due to a suitable signal sequence, the scFv-chain is exported into the periplasma where it folds into a functional conformation.

Single E. coli TG1 bacterial colonies from the transformation plates are picked for periplasmic small scale preparations and grown in SB-medium (e.g. 10 ml) supplemented with 20 mM MgCl$_2$ and carbenicillin 50 µg/ml (and redissolved in PBS (e.g. 1 ml) after harvesting. By four rounds of freezing at −70° C. and thawing at 37° C., the outer membrane of the bacteria is destroyed by temperature shock and the soluble periplasmic proteins including the scFvs are released into the supernatant. After elimination of intact cells and cell-debris by centrifugation, the supernatant containing the anti-PSMA scFvs is collected and used for the determination of binding to different cell lines.

3.2. Flow Cytometric Binding Analysis of Single Chain Antibody Constructs to Various Cell Lines Periplasmic preparations of E. coli clones producing the scFv molecules EpCAM 4-7, PM74-G3, PM52-H3, PM52-C3, PM75-A10 and PM91-B6 are used to examine specific binding to human PSMA or human EpCAM transfected cell lines. As negative control untransfected CHO cell are used.

For flow cytometry 2,5×10$^5$ cells are incubated with 50 µl of scFv periplasmic preparation. The binding of scFv to the cells is detected with an anti-His antibody (Penta-His Antibody, BSA free, Qiagen GmbH, Hilden, FRG) at 2 µg/ml in 50 µl PBS with 2% FCS. As a second step reagent a R-Phycoerythrin-conjugated affinity purified F(ab')2 fragment, goat anti-mouse IgG (Fc-gamma fragment specific), diluted 1:100 in 50 µl PBS with 2% FCS (Dianova, Hamburg, FRG) is used. The samples are measured on a FACSscan (BD biosciences, Heidelberg, FRG).

Flow cytometry is performed on a FACS-Calibur apparatus; the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

scFv EpCAM 4-7 showed strong binding to the human EpCAM transfected CHO cell line but no significant binding to human PSMA transfected or untransfected cells. In contrast scFvs PM74-G3, PM52-H3, PM52-C3, PM75-A10 and PM91-B6 showed strong binding to human PSMA transfected CHO cells but not to human EpCAM transfected or untransfected CHO cells. (The binding results of the periplasmatic cell extracts of the respective scFvs on the different transfected cell lines are listed in table 1).

TABLE 1

Results of FACS analysis: '+' indicates binding signal, '−' indicates no significant binding signal

| SEQ ID (nucl/prot) | scFv constructs | EpCAM transfected CHO cells | PSMA transfected CHO cells | untransfected CHO cells |
| --- | --- | --- | --- | --- |
| | EpCAM 4-7 | + | − | − |
| | PM74-G3 | − | + | − |
| | PM52-C3 | − | + | − |
| | PM52-H3 | − | + | − |
| | PM75-A10 | − | + | − |
| | PM91-B6 | − | + | − |

| SEQ ID NO. | DESIGNATION | SOURCE | TYPE | SEQUENCE |
| --- | --- | --- | --- | --- |
| 1. | Human CD3ε extracellular domain | human | aa | QDGNEEMGGITQTPYKVSISGTTVILTCPQYPGSEILWQHNDKNIGGD EDDKNIGSDEDHLSLKEFSELEQSGYYVCYPRGSKPEDANFYLYLRAR VCENCMEMD |
| 2. | Human CD3ε 1-27 | human | aa | QDGNEEMGGITQTPYKVSISGTTVILT |
| 3. | Callithrix jacchus CD3ε extracellular domain | Callithrix jacchus | aa | QDGNEEMGDTTQNPYKVSISGTTVTLTCPRYDGHEIKWLVNSQNKEGH EDHLLLEDFSEMEQSGYYACLSKETPAEEASHYLYLKARVCENCVEVD |
| 4. | Callithrix jacchus CD3ε 1-27 | Callithrix jacchus | aa | QDGNEEMGDTTQNPYKVSISGTTVTLT |
| 5. | Saguinus oedipus CD3ε extracellular domain | Saguinus oedipus | aa | QDGNEEMGDTTQNPYKVSISGTTVTLTCPRYDGHEIKWLVNSQNKEGH EDHLLLEDFSEMEQSGYYACLSKETPAEEASHYLYLKARVCENCVEVD |
| 6. | Saguinus oedipus CD3ε 1-27 | Saguinus oedipus | aa | QDGNEEMGDTTQNPYKVSISGTTVTLT |
| 7. | Saimiri sciureus CD3ε extracellular domain | Saimiri sciureus | aa | QDGNEEIGDTTQNPYKVSISGTTVTLTCPRYDGQEIKWLVNDQNKEGH EDHLLLEDFSEMEQSGYYACLSKETPTEEASHYLYLKARVCENCVEVD |
| 8. | Saimiri sciureus CD3ε 1-27 | Saimiri sciureus | aa | QDGNEEIGDTTQNPYKVSISGTTVTLT |
| 9. | CDR-L1 of F6A | artificial | aa | GSSTGAVTSGYYPN |
| 10. | CDR-L2 of F6A | artificial | aa | GTKFLAP |
| 11. | CDR-L3 of F6A | artificial | aa | ALWYSNRWV |
| 12. | CDR-H1 of F6A | artificial | aa | IYAMN |
| 13. | CDR-H2 of F6A | artificial | aa | RIRSKYNNYATYYADSVKS |
| 14. | CDR-H3 of F6A | artificial | aa | HGNFGNSYVSFFAY |
| 15. | VH of F6A | artificial | aa | EVQLVESGGGLVQPGGSLKLSCAASGFTFNIYAMNWVRQAPGKGLEWV ARIRSKYNNYATYYADSVKSRFTISRDDSKNTAYLQMNNLKTEDTAVY YCVRHGNFGNSYVSFFAYWGQGTLVTSS |
| 16. | VH of F6A | artificial | nt | GAGGTGCAGCTGGTCGAGTCTGGAGGAGGATTGGTGCAGCCTGGAGGG TCATTGAAACTCTCATGTGCAGCCTCTGGATTCACCTTCAATATCTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAAAGCAGGTTCACCATCTCCAGAGATGATTCAAAAAACACT GCCTATCTACAAATGAACAACTTGAAAACTGAGGACACTGCCGTGTAC TACTGTGTGAGACATGGGAACTTCGGTAATAGCTACGTATCCTTCTTC GCTTACTGGGGCCAAGGGACTCTGGTCACCGTCTCCTCA |
| 17. | VL of F6A | artificial | aa | QTVVTQEPSLTVSPGGTVTLTCGSSTGAVTSGYYPNWVQQKPGQAPRG LIGGTKFLAPGTPARFSGSLLGGKAALTLSGVQPEDEAEYYCALWYSN RWVFGGGTKLTVL |

| SEQ ID NO. | DESIGNATION | SOURCE | TYPE | SEQUENCE |
|---|---|---|---|---|
| 18. | VL of F6A | artificial | nt | CAGACTGTTGTGACTCAGGAACCTTCACTCACCGTATCACCTGGTGGA ACAGTCACACTCACTTGTGGCTCCTCGACTGGGGCTGTTACATCTGGC TACTACCCAAACTGGGTCCAACAAAAACCAGGTCAGGCACCCCGTGGT CTAATAGGTGGGACTAAGTTCCTCGCCCCCGGTACTCCTGCCAGATTC TCAGGCTCCCTGCTTGGAGGCAAGGCTGCCCTCACCCTCTCAGGGGTA CAGCCAGAGGATGAGGCAGAATATTACTGTGCTCTATGGTACAGCAAC CGCTGGGTGTTCGGTGGAGGAACCAAACTGACTGTCCTA |
| 19. | VH-P of F6A | artificial | aa | EVQLLESGGGLVQPGGSLKLSCAASGFTFNIYAMNWVRQAPGKGLEWV ARIRSKYNNYATYYADSVKSRFTISRDDSKNTAYLQMNNLKTEDTAVY YCVRHGNFGNSYVSFFAYWGQGTLVTVSS |
| 20. | VH-P of F6A | artificial | nt | GAGGTGCAGCTGCTCGAGTCTGGAGGAGGATTGGTGCAGCCTGGAGGG TCATTGAAACTCTCATGTGCAGCCTCTGGATTCACCTTCAATATCTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAAAGCAGGTTCACCATCTCCAGAGATGATTCAAAAACACT GCCTATCTACAAATGAACAACTTGAAAACTGAGGACACTGCCGTGTAC TACTGTGTGAGACATGGGAACTTCGGTAATAGCTACGTATCCTTCTTC GCTTACTGGGGCCAAGGGACTCTGGTCACCGTCTCCTCA |
| 21. | VL-P of F6A | artificial | aa | ELVVTQEPSLTVSPGGTVTLTCGSSTGAVTSGYYPNWVQQKPGQAPRG LIGGTKFLAPGTPARFSGSLLGGKAALTLSGVQPEDEAEYYCALWYSN RWVFGGGTKLTVL |
| 22. | VL-P of F6A | artificial | nt | GAGCTCGTTGTGACTCAGGAACCTTCACTCACCGTATCACCTGGTGGA ACAGTCACACTCACTTGTGGCTCCTCGACTGGGGCTGTTACATCTGGC TACTACCCAAACTGGGTCCAACAAAAACCAGGTCAGGCACCCCGTGGT CTAATAGGTGGGACTAAGTTCCTCGCCCCCGGTACTCCTGCCAGATTC TCAGGCTCCCTGCTTGGAGGCAAGGCTGCCCTCACCCTCTCAGGGGTA CAGCCAGAGGATGAGGCAGAATATTACTGTGCTCTATGGTACAGCAAC CGCTGGGTGTTCGGTGGAGGAACCAAACTGACTGTCCTA |
| 23. | VH-VL of F6A | artificial | aa | EVQLVESGGGLVQPGGSLKLSCAASGFTFNIYAMNWVRQAPGKGLEWV ARIRSKYNNYATYYADSVKSRFTISRDDSKNTAYLQMNNLKTEDTAVY YCVRHGNFGNSYVSFFAYWGQGTLVTVSSGGGGSGGGGSGGGGSQTVV TQEPSLTVSPGGTVTLTCGSSTGAVTSGYYPNWVQQKPGQAPRGLIGG TKFLAPGTPARFSGSLLGGKAALTLSGVQPEDEAEYYCALWYSNRWVF GGGTKLTVL |
| 24. | VH-VL of F6A | artificial | nt | GAGGTGCAGCTGGTCGAGTCTGGAGGAGGATTGGTGCAGCCTGGAGGG TCATTGAAACTCTCATGTGCAGCCTCTGGATTCACCTTCAATATCTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAAAGCAGGTTCACCATCTCCAGAGATGATTCAAAAACACT GCCTATCTACAAATGAACAACTTGAAAACTGAGGACACTGCCGTGTAC TACTGTGTGAGACATGGGAACTTCGGTAATAGCTACGTATCCTTCTTC GCTTACTGGGGCCAAGGGACTCTGGTCACCGTCTCCTCAGGTGGTGGT GGTTCTGGCGGCGGCGGCTCCGGTGGTGGTGGTTCTCAGACTGTTGTG ACTCAGGAACCTTCACTCACCGTATCACCTGGTGAACAGTCACACTC ACTTGTGGCTCCTCGACTGGGGCTGTTACATCTGGCTACTACCCAAAC TGGGTCCAACAAAAACCAGGTCAGGCACCCCGTGGTCTAATAGGTGGG ACTAAGTTCCTCGCCCCCGGTACTCCTGCCAGATTCTCAGGCTCCCTG CTTGGAGGCAAGGCTGCCCTCACCCTCTCAGGGGTACAGCCAGAGGAT GAGGCAGAATATTACTGTGCTCTATGGTACAGCAACCGCTGGGTGTTC GGTGGAGGAACCAAACTGACTGTCCTA |
| 25. | VH-VL-P of F6A | artificial | aa | EVQLLESGGGLVQPGGSLKLSCAASGFTFNIYAMNWVRQAPGKGLEWV ARIRSKYNNYATYYADSVKSRFTISRDDSKNTAYLQMNNLKTEDTAVY YCVRHGNFGNSYVSFFAYWGQGTLVTVSSGGGGSGGGGSGGGGSELVV TQEPSLTVSPGGTVTLTCGSSTGAVTSGYYPNWVQQKPGQAPRGLIGG TKFLAPGTPARFSGSLLGGKAALTLSGVQPEDEAEYYCALWYSNRWVF GGGTKLTVL |
| 26. | VH-VL-P of F6A | artificial | nt | GAGGTGCAGCTGCTCGAGTCTGGAGGAGGATTGGTGCAGCCTGGAGGG TCATTGAAACTCTCATGTGCAGCCTCTGGATTCACCTTCAATATCTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAAAGCAGGTTCACCATCTCCAGAGATGATTCAAAAACACT GCCTATCTACAAATGAACAACTTGAAAACTGAGGACACTGCCGTGTAC TACTGTGTGAGACATGGGAACTTCGGTAATAGCTACGTATCCTTCTTC GCTTACTGGGGCCAAGGGACTCTGGTCACCGTCTCCTCAGGTGGTGGT GGTTCTGGCGGCGGCGGCTCCGGTGGTGGTGGTTCTGAGCTCGTTGTG ACTCAGGAACCTTCACTCACCGTATCACCTGGTGGAACAGTCACACTC ACTTGTGGCTCCTCGACTGGGCTGTTACATCTGGCTACTACCCAAAC TGGGTCCAACAAAAACCAGGTCAGGCACCCCGTGGTCTAATAGGTGGG |

| SEQ ID NO. | DESIGNATION | SOURCE | TYPE | SEQUENCE |
|---|---|---|---|---|
| | | | | ACTAAGTTCCTCGCCCCCGGTACTCCTGCCAGATTCTCAGGCTCCCTG<br>CTTGGAGGCAAGGCTGCCCTCACCCTCTCAGGGGTACAGCCAGAGGAT<br>GAGGCAGAATATTACTGTGCTCTATGGTACAGCAACCGCTGGGTGTTC<br>GGTGGAGGAACCAAACTGACTGTCCTA |
| 27. | CDR-L1 of H2C | artificial | aa | GSSTGAVTSGYYPN |
| 28. | CDR-L2 of H2C | artificial | aa | GTKFLAP |
| 29. | CDR-L3 of H2C | artificial | aa | ALWYSNRWV |
| 30. | CDR-H1 of H2C | artificial | aa | KYAMN |
| 31. | CDR-H2 of H2C | artificial | aa | RIRSKYNNYATYYADSVKD |
| 32. | CDR-H3 of H2C | artificial | aa | HGNFGNSYISYWAY |
| 33. | VH of H2C | artificial | aa | EVQLVESGGGLVQPGGSLKLSCAASGFTFNKYAMNWVRQAPGKGLEWV<br>ARIRSKYNNYATYYADSVKDRFTISRDDSKNTAYLQMNNLKTEDTAVY<br>YCVRHGNFGNSYISYWAYWGQGTLVTVSS |
| 34. | VH of H2C | artificial | nt | GAGGTGCAGCTGGTCGAGTCTGGAGGAGGATTGGTGCAGCCTGGAGGG<br>TCATTGAAACTCTCATGTGCAGCCTCTGGATTCACCTTCAATAAGTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGACAGGTTCACCATCTCCAGAGATGATTCAAAAACACT<br>GCCTATCTACAAATGAACAACTTGAAAACTGAGGACACTGCCGTGTAC<br>TACTGTGTGAGACATGGGAACTTCGGTAATAGCTACATATCCTACTGG<br>GCTTACTGGGGCCAAGGGACTCTGGTCACCGTCTCCTCA |
| 35. | VL of H2C | artificial | aa | QTVVTQEPSLTVSPGGTVTLTCGSSTGAVTSGYYPNWVQQKPGQAPRG<br>LIGGTKFLAPGTPARFSGSLLGGKAALTLSGVQPEDEAEYYCALWYSN<br>RWVFGGGTKLTVL |
| 36. | VL of H2C | artificial | nt | CAGACTGTTGTGACTCAGGAACCTTCACTCACCGTATCACCTGGTGGA<br>ACAGTCACACTCACTTGTGGCTCCTCGACTGGGGCTGTTACATCTGGC<br>TACTACCCAAACTGGGTCCAACAAAAACCAGGTCAGGCACCCCGTGGT<br>CTAATAGGTGGGACTAAGTTCCTCGCCCCCGGTACTCCTGCCAGATTC<br>TCAGGCTCCCTGCTTGGAGGCAAGGCTGCCCTCACCCTCTCAGGGGTA<br>CAGCCAGAGGATGAGGCAGAATATTACTGTGCTCTATGGTACAGCAAC<br>CGCTGGGTGTTCGGTGGAGGAACCAAACTGACTGTCCTA |
| 37. | VH-P of H2C | artificial | aa | EVQLLESGGGLVQPGGSLKLSCAASGFTFNKYAMNWVRQAPGKGLEWV<br>ARIRSKYNNYATYYADSVKDRFTISRDDSKNTAYLQMNNLKTEDTAVY<br>YCVRHGNFGNSYISYWAYWGQGTLVTVSS |
| 38. | VH-P of H2C | artificial | nt | GAGGTGCAGCTGCTCGAGTCTGGAGGAGGATTGGTGCAGCCTGGAGGG<br>TCATTGAAACTCTCATGTGCAGCCTCTGGATTCACCTTCAATAAGTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGACAGGTTCACCATCTCCAGAGATGATTCAAAAACACT<br>GCCTATCTACAAATGAACAACTTGAAAACTGAGGACACTGCCGTGTAC<br>TACTGTGTGAGACATGGGAACTTCGGTAATAGCTACATATCCTACTGG<br>GCTTACTGGGGCCAAGGGACTCTGGTCACCGTCTCCTCA |
| 39. | VL-P of H2C | artificial | aa | ELVVTQEPSLTVSPGGTVTLTCGSSTGAVTSGYYPNWVQQKPGQAPRG<br>LIGGTKFLAPGTPARFSGSLLGGKAALTLSGVQPEDEAEYYCALWYSN<br>RWVFGGGTKLTVL |
| 40. | VL-P of H2C | artificial | nt | GAGCTCGTTGTGACTCAGGAACCTTCACTCACCGTATCACCTGGTGGA<br>ACAGTCACACTCACTTGTGGCTCCTCGACTGGGGCTGTTACATCTGGC<br>TACTACCCAAACTGGGTCCAACAAAAACCAGGTCAGGCACCCCGTGGT<br>CTAATAGGTGGGACTAAGTTCCTCGCCCCCGGTACTCCTGCCAGATTC<br>TCAGGCTCCCTGCTTGGAGGCAAGGCTGCCCTCACCCTCTCAGGGGTA<br>CAGCCAGAGGATGAGGCAGAATATTACTGTGCTCTATGGTACAGCAAC<br>CGCTGGGTGTTCGGTGGAGGAACCAAACTGACTGTCCTA |
| 41. | VH-VL of H2C | artificial | aa | EVQLVESGGGLVQPGGSLKLSCAASGFTFNKYAMNWVRQAPGKGLEWV<br>ARIRSKYNNYATYYADSVKDRFTISRDDSKNTAYLQMNNLKTEDTAVY<br>YCVRHGNFGNSYISYWAYWGQGTLVTVSSGGGGSGGGGSGGGGSQTVV<br>TQEPSLTVSPGGTVTLTCGSSTGAVTSGYYPNWVQQKPGQAPRGLIGG<br>TKFLAPGTPARFSGSLLGGKAALTLSGVQPEDEAEYYCALWYSNRWVF<br>GGGTKLTVL |
| 42. | VH-VL of H2C | artificial | nt | GAGGTGCAGCTGGTCGAGTCTGGAGGAGGATTGGTGCAGCCTGGAGGG<br>TCATTGAAACTCTCATGTGCAGCCTCTGGATTCACCTTCAATAAGTAC<br>GCCATGAACTGGGTCCGCCAGGCTCCAGGAAAGGGTTTGGAATGGGTT |

-continued

| SEQ ID NO. | DESIGNATION | SOURCE | TYPE | SEQUENCE |
|---|---|---|---|---|
| | | | | GCTCGCATAAGAAGTAAATATAATAATTATGCAACATATTATGCCGAT<br>TCAGTGAAAGACAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACATATCCTACTGG<br>GCTTACTGGGGCCAAGGGACTCTGGTCACCGTCTCCTCAGGTGGTGGT<br>GGTTCTGGCGGCGGCGGCTCCGGTGGTGGTGGTTCTCAGACTGTTGTG<br>ACTCAGGAACCTTCACTCACCGTATCCACCTGGTGGAACAGTCACACTC<br>ACTTGTGGCTCCTCGACTGGGGCTGTTACATCTGGCTACTACCCAAAC<br>TGGGTCCAACAAAAACCAGGTCAGGCACCCCGTGGTCTAATAGGTGGG<br>ACTAAGTTCCTCGCCCCCGGTACTCCTGCCAGATTCTCAGGCTCCCTG<br>CTTGGAGGCAAGGCTGCCCTCACCCTCTCAGGGGTACAGCCAGAGGAT<br>GAGGCAGAATATTACTGTGCTCTATGGTACAGCAACCGCTGGGTGTTC<br>GGTGGAGGAACCAAACTGACTGTCCTA |
| 43. | VH-VL-P of H2C | artificial | aa | EVQLLESGGGLVQPGGSLKLSCAASGFTFNKYAMNWVRQAPGKGLEWV<br>ARIRSKYNNYATYYADSVKDRFTISRDDSKNTAYLQMNNLKTEDTAVY<br>YCVRHGNFGNSYISYWAYWGQGTLVTVSSGGGGSGGGGSGGGGSELVV<br>TQEPSLTVSPGGTVTLTCGSSTGAVTSGYYPNWVQQKPGQAPRGLIGG<br>TKFLAPGTPARFSGSLLGGKAALTLSGVQPEDEAEYYCALWYSNRWVF<br>GGGTKLTVL |
| 44. | VH-VL-P of H2C | artificial | nt | GAGGTGCAGCTGCTCGAGTCTGGAGGAGGATTGGTGCAGCCTGGAGGG<br>TCATTGAAACTCTCATGTGCAGCCTCTGGATTCACCTTCAATAAGTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGACAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACATATCCTACTGG<br>GCTTACTGGGGCCAAGGGACTCTGGTCACCGTCTCCTCAGGTGGTGGT<br>GGTTCTGGCGGCGGCGGCTCCGGTGGTGGTGGTTCTGAGCTCGTTGTG<br>ACTCAGGAACCTTCACTCACCGTATCCACCTGGTGGAACAGTCACACTC<br>ACTTGTGGCTCCTCGACTGGGGCTGTTACATCTGGCTACTACCCAAAC<br>TGGGTCCAACAAAAACCAGGTCAGGCACCCCGTGGTCTAATAGGTGGG<br>ACTAAGTTCCTCGCCCCCGGTACTCCTGCCAGATTCTCAGGCTCCCTG<br>CTTGGAGGCAAGGCTGCCCTCACCCTCTCAGGGGTACAGCCAGAGGAT<br>GAGGCAGAATATTACTGTGCTCTATGGTACAGCAACCGCTGGGTGTTC<br>GGTGGAGGAACCAAACTGACTGTCCTA |
| 45. | CDR-L1 of H1E | artificial | aa | GSSTGAVTSGYYPN |
| 46. | CDR-L2 of H1E | artificial | aa | GTKFLAP |
| 47. | CDR-L3 of H1E | artificial | aa | ALWYSNRWV |
| 48. | CDR-H1 of H1E | artificial | aa | SYAMN |
| 49. | CDR-H2 of H1E | artificial | aa | RIRSKYNNYATYYADSVKG |
| 50. | CDR-H3 of H1E | artificial | aa | HGNFGNSYLSFWAY |
| 51. | VH of H1E | artificial | aa | EVQLVESGGGLEQPGGSLKLSCAASGFTFNSYAMNWVRQAPGKGLEWV<br>ARIRSKYNNYATYYADSVKGRFTISRDDSKNTAYLQMNNLKTEDTAVY<br>YCVRHGNFGNSYLSFWAYWGQGTLVTVSS |
| 52. | VH of H1E | artificial | nt | GAGGTGCAGCTGGTCGAGTCTGGAGGAGGATTGGAGCAGCCTGGAGGG<br>TCATTGAAACTCTCATGTGCAGCCTCTGGATTCACCTTCAATTCGTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGGGAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACCTATCCTTCTGG<br>GCTTACTGGGGCCAAGGGACTCTGGTCACCGTCTCCTC |
| 53. | VL of H1E | artificial | aa | QTVVTQEPSLTVSPGGTVTLTCGSSTGAVTSGYYPNWVQQKPGQAPRG<br>LIGGTKFLAPGTPARFSGSLLGGKAALTLSGVQPEDEAEYYCALWYSN<br>RWVFGGGTKLTVL |
| 54. | VL of H1E | artificial | nt | CAGACTGTTGTGACTCAGGAACCTTCACTCACCGTATCCACCTGGTGGA<br>ACAGTCACACTCACTTGTGGCTCCTCGACTGGGGCTGTTACATCTGGC<br>TACTACCCAAACTGGGTCCAACAAAAACCAGGTCAGGCACCCCGTGGT<br>CTAATAGGTGGGACTAAGTTCCTCGCCCCCGGTACTCCTGCCAGATTC<br>TCAGGCTCCCTGCTTGGAGGCAAGGCTGCCCTCACCCTCTCAGGGGTA<br>CAGCCAGAGGATGAGGCAGAATATTACTGTGCTCTATGGTACAGCAAC<br>CGCTGGGTGTTCGGTGGAGGAACCAAACTGACTGTCCTA |

| SEQ ID NO. | DESIGNATION | SOURCE | TYPE | SEQUENCE |
|---|---|---|---|---|
| 55. | VH-P of H1E | artificial | aa | EVQLLESGGGLEQPGGSLKLSCAASGFTFNSYAMNWVRQAPGKGLEWV ARIRSKYNNYATYYADSVKGRFTISRDDSKNTAYLQMNNLKTEDTAVY YCVRHGNFGNSYLSFWAYWGQGTLVTVSS |
| 56. | VH-P of H1E | artificial | nt | GAGGTGCAGCTGCTCGAGTCTGGAGGAGGATTGGAGCAGCCTGGAGGG TCATTGAAACTCTCATGTGCAGCCTCTGGATTCACCTTCAATTCGTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAAGGGAGGTTCACCATCTCCAGAGATGATTCAAAAAACACT GCCTATCTACAAATGAACAACTTGAAAACTGAGGACACTGCCGTGTAC TACTGTGTGAGACATGGGAACTTCGGTAATAGCTACCTATCCTTCTGG GCTTACTGGGGCCAAGGGACTCTGGTCACCGTCTCCTCA |
| 57. | VL-P of H1E | artificial | aa | ELVVTQEPSLTVSPGGTVTLTCGSSTGAVTSGYYPNWVQQKPGQAPRG LIGGTKFLAPGTPARFSGSLLGGKAALTLSGVQPEDEAEYYCALWYSN RWVFGGGTKLTVL |
| 58. | VL-P of H1E | artificial | nt | GAGCTCGTTGTGACTCAGGAACCTTCACTCACCGTATCACCTGGTGGA ACAGTCACACTCACTTGTGGCTCCTCGACTGGGGCTGTTACATCTGGC TACTACCCAAACTGGGTCCAACAAAAACCAGGTCAGGCACCCCGTGGT CTAATAGGTGGGACTAAGTTCCTCGCCCCCGGTACTCCTGCCAGATTC TCAGGCTCCCTGCTTGGAGGCAAGGCTGCCCTCACCCTCTCAGGGGTA CAGCCAGAGGATGAGGCAGAATATTACTGTGCTCTATGGTACAGCAAC CGCTGGGTGTTCGGTGGAGGAACCAAACTGACTGTCCTA |
| 59. | VH-VL of H1E | artificial | aa | EVQLVESGGGLEQPGGSLKLSCAASGFTFNSYAMNWVRQAPGKGLEWV ARIRSKYNNYATYYADSVKGRFTISRDDSKNTAYLQMNNLKTEDTAVY YCVRHGNFGNSYLSFWAYWGQGTLVTVSSGGGGSGGGGSGGGGSQTVV TQEPSLTVSPGGTVTLTCGSSTGAVTSGYYPNWVQQKPGQAPRGLIGG TKFLAPGTPARFSGSLLGGKAALTLSGVQPEDEAEYYCALWYSNRWVF GGGTKLTVL |
| 60. | VH-VL of H1E | artificial | nt | GAGGTGCAGCTGGTCGAGTCTGGAGGAGGATTGGAGCAGCCTGGAGGG TCATTGAAACTCTCATGTGCAGCCTCTGGATTCACCTTCAATTCGTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAAGGGAGGTTCACCATCTCCAGAGATGATTCAAAAAACACT GCCTATCTACAAATGAACAACTTGAAAACTGAGGACACTGCCGTGTAC TACTGTGTGAGACATGGGAACTTCGGTAATAGCTACCTATCCTTCTGG GCTTACTGGGGCCAAGGGACTCTGGTCACCGTCTCCTCAGGTGGTGGT GGTTCTGGCGGCGGCGGCTCCGGTGGTGGTGGTTCTCAGACTGTTGTG ACTCAGGAACCTTCACTCACCGTATCACCTGGTGAACAGTCACACTC ACTTGTGGCTCCTCGACTGGGGCTGTTACATCTGGCTACTACCCAAAC TGGGTCCAACAAAAACCAGGTCAGGCACCCCGTGGTCTAATAGGTGGG ACTAAGTTCCTCGCCCCCGGTACTCCTGCCAGATTCTCAGGCTCCCTG CTTGGAGGCAAGGCTGCCCTCACCCTCTCAGGGGTACAGCCAGAGGAT GAGGCAGAATATTACTGTGCTCTATGGTACAGCAACCGCTGGGTGTTC GGTGGAGGAACCAAACTGACTGTCCTA |
| 61. | VH-VL-P of H1E | artificial | aa | EVQLLESGGGLEQPGGSLKLSCAASGFTFNSYAMNWVRQAPGKGLEWV ARIRSKYNNYATYYADSVKGRFTISRDDSKNTAYLQMNNLKTEDTAVY YCVRHGNFGNSYLSFWAYWGQGTLVTVSSGGGGSGGGGSGGGGSELVV TQEPSLTVSPGGTVTLTCGSSTGAVTSGYYPNWVQQKPGQAPRGLIGG TKFLAPGTPARFSGSLLGGKAALTLSGVQPEDEAEYYCALWYSNRWVF GGGTKLTVL |
| 62. | VH-VL-P of H1E | artificial | nt | GAGGTGCAGCTGCTCGAGTCTGGAGGAGGATTGGAGCAGCCTGGAGGG TCATTGAAACTCTCATGTGCAGCCTCTGGATTCACCTTCAATTCGTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAAGGGAGGTTCACCATCTCCAGAGATGATTCAAAAAACACT GCCTATCTACAAATGAACAACTTGAAAACTGAGGACACTGCCGTGTAC TACTGTGTGAGACATGGGAACTTCGGTAATAGCTACCTATCCTTCTGG GCTTACTGGGGCCAAGGGACTCTGGTCACCGTCTCCTCAGGTGGTGGT GGTTCTGGCGGCGGCGGCTCCGGTGGTGGTGGTTCTGAGCTCGTTGTG ACTCAGGAACCTTCACTCACCGTATCACCTGGTGAACAGTCACACTC ACTTGTGGCTCCTCGACTGGGGCTGTTACATCTGGCTACTACCCAAAC TGGGTCCAACAAAAACCAGGTCAGGCACCCCGTGGTCTAATAGGTGGG ACTAAGTTCCTCGCCCCCGGTACTCCTGCCAGATTCTCAGGCTCCCTG CTTGGAGGCAAGGCTGCCCTCACCCTCTCAGGGGTACAGCCAGAGGAT GAGGCAGAATATTACTGTGCTCTATGGTACAGCAACCGCTGGGTGTTC GGTGGAGGAACCAAACTGACTGTCCTA |

| SEQ ID NO. | DESIGNATION | SOURCE | TYPE | SEQUENCE |
|---|---|---|---|---|
| 63. | CDR-L1 of G4H | artificial | aa | GSSTGAVTSGYYPN |
| 64. | CDR-L2 of G4H | artificial | aa | GTKFLAP |
| 65. | CDR-L3 of G4H | artificial | aa | ALWYSNRWV |
| 66. | CDR-H1 of G4H | artificial | aa | RYAMN |
| 67. | CDR-H2 of G4H | artificial | aa | RIRSKYNNYATYYADSVKG |
| 68. | CDR-H3 of G4H | artificial | aa | HGNFGNSYLSYFAY |
| 69. | VH of G4H | artificial | aa | EVQLVESGGGLVQPGGSLKLSCAASGFTFNRYAMNWVRQAPGKGLEWV ARIRSKYNNYATYYADSVKGRFTISRDDSKNTAYLQMNNLKTEDTAVY YCVRHGNFGNSYLSYFAYWGQGTLVTVSS |
| 70. | VH of G4H | artificial | nt | GAGGTGCAGCTGGTCGAGTCTGGAGGAGGATTGGTGCAGCCTGGAGGG TCATTGAAACTCTCATGTGCAGCCTCTGGATTCACCTTCAATCGCTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAAGGGAGGTTCACCATCTCCAGAGATGATTCAAAAAACACT GCCTATCTACAAATGAACAACTTGAAAACTGAGGACACTGCCGTGTAC TACTGTGTGAGACATGGGAACTTCGGTAATAGCTACTTATCCTACTTC GCTTACTGGGGCCAAGGGACTCTGGTCACCGTCTCCTCA |
| 71. | VL of G4H | artificial | aa | QTVVTQEPSLTVSPGGTVTLTCGSSTGAVTSGYYPNWVQQKPGQAPRG LIGGTKFLAPGTPARFSGSLLGGKAALTLSGVQPEDEAEYYCALWYSN RWVFGGGTKLTVL |
| 72. | VL of G4H | artificial | nt | CAGACTGTTGTGACTCAGGAACCTTCACTCACCGTATCACCTGGTGGA ACAGTCACACTCACTTGTGGCTCCTCGACTGGGGCTGTTACATCTGGC TACTACCCAAACTGGGTCCAACAAAAACCAGGTCAGGCACCCCGTGGT CTAATAGGTGGGACTAAGTTCCTCGCCCCCGGTACTCCTGCCAGATTC TCAGGCTCCCTGCTTGGAGGCAAGGCTGCCCTCACCCTCTCAGGGGTA CAGCCAGAGGATGAGGCAGAATATTACTGTGCTCTATGGTACAGCAAC CGCTGGGTGTTCGGTGGAGGAACCAAACTGACTGTCCTA |
| 73. | VH-P of G4H | artificial | aa | EVQLLESGGGLVQPGGSLKLSCAASGFTFNRYAMNWVRQAPGKGLEWV ARIRSKYNNYATYYADSVKGRFTISRDDSKNTAYLQMNNLKTEDTAVY YCVRHGNFGNSYLSYFAYWGQGTLVTVSS |
| 74. | VH-P of G4H | artificial | nt | GAGGTGCAGCTGCTCGAGTCTGGAGGAGGATTGGTGCAGCCTGGAGGG TCATTGAAACTCTCATGTGCAGCCTCTGGATTCACCTTCAATCGCTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAAGGGAGGTTCACCATCTCCAGAGATGATTCAAAAAACACT GCCTATCTACAAATGAACAACTTGAAAACTGAGGACACTGCCGTGTAC TACTGTGTGAGACATGGGAACTTCGGTAATAGCTACTTATCCTACTTC GCTTACTGGGGCCAAGGGACTCTGGTCACCGTCTCCTCA |
| 75. | VL-P of G4H | artificial | aa | ELVVTQEPSLTVSPGGTVTLTCGSSTGAVTSGYYPNWVQQKPGQAPRG LIGGTKFLAPGTPARFSGSLLGGKAALTLSGVQPEDEAEYYCALWYSN RWVFGGGTKLTVL |
| 76. | VL-P of G4H | artificial | nt | GAGCTCGTTGTGACTCAGGAACCTTCACTCACCGTATCACCTGGTGGA ACAGTCACACTCACTTGTGGCTCCTCGACTGGGGCTGTTACATCTGGC TACTACCCAAACTGGGTCCAACAAAAACCAGGTCAGGCACCCCGTGGT CTAATAGGTGGGACTAAGTTCCTCGCCCCCGGTACTCCTGCCAGATTC TCAGGCTCCCTGCTTGGAGGCAAGGCTGCCCTCACCCTCTCAGGGGTA CAGCCAGAGGATGAGGCAGAATATTACTGTGCTCTATGGTACAGCAAC CGCTGGGTGTTCGGTGGAGGAACCAAACTGACTGTCCTA |
| 77. | VH-VL of G4H | artificial | aa | EVQLVESGGGLVQPGGSLKLSCAASGFTFNRYAMNWVRQAPGKGLEWV ARIRSKYNNYATYYADSVKGRFTISRDDSKNTAYLQMNNLKTEDTAVY YCVRHGNFGNSYLSYFAYWGQGTLVTVSSGGGGSGGGGSGGGGSQTVV TQEPSLTVSPGGTVTLTCGSSTGAVTSGYYPNWVQQKPGQAPRGLIGG TKFLAPGTPARFSGSLLGGKAALTLSGVQPEDEAEYYCALWYSNRWVF GGGTKLTVL |
| 78. | VH-VL of G4H | artificial | nt | GAGGTGCAGCTGGTCGAGTCTGGAGGAGGATTGGTGCAGCCTGGAGGG TCATTGAAACTCTCATGTGCAGCCTCTGGATTCACCTTCAATCGCTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAAGGGAGGTTCACCATCTCCAGAGATGATTCAAAAAACACT GCCTATCTACAAATGAACAACTTGAAAACTGAGGACACTGCCGTGTAC TACTGTGTGAGACATGGGAACTTCGGTAATAGCTACTTATCCTACTTC |

| SEQ ID NO. | DESIGNATION | SOURCE | TYPE | SEQUENCE |
|---|---|---|---|---|
| | | | | GCTTACTGGGGCCAAGGGACTCTGGTCACCGTCTCCTCAGGTGGTGGT<br>GGTTCTGGCGGCGGCGGCTCCGGTGGTGGTGGTTCTCAGACTGTTGTG<br>ACTCAGGAACCTTCACTCACCGTATCACCTGGTGGAACAGTCACACTC<br>ACTTGTGGCTCCTCGACTGGGGCTGTTACATCTGGCTACTACCCAAAC<br>TGGGTCCAACAAAAACCAGGTCAGGCACCCCGTGGTCTAATAGGTGGG<br>ACTAAGTTCCTCGCCCCCGGTACTCCTGCCAGATTCTCAGGCTCCCTG<br>CTTGGAGGCAAGGCTGCCCTCACCCTCTCAGGGGTACAGCCAGAGGAT<br>GAGGCAGAATATTACTGTGCTCTATGGTACAGCAACCGCTGGGTGTTC<br>GGTGGAGGAACCAAACTGACTGTCCTA |
| 79. | VH-VL-P of G4H | artificial | aa | EVQLLESGGGLVQPGGSLKLSCAASGFTFNRYAMNWVRQAPGKGLEWV<br>ARIRSKYNNYATYYADSVKGRFTISRDDSKNTAYLQMNNLKTEDTAVY<br>YCVRHGNFGNSYLSYFAYWGQGTLVTVSSGGGGSGGGGSGGGGSELVV<br>TQEPSLTVSPGGTVTLTCGSSTGAVTSGYYPNWVQQKPGQAPRGLIGG<br>TKFLAPGTPARFSGSLLGGKAALTLSGVQPEDEAEYYCALWYSNRWVF<br>GGGTKLTVL |
| 80. | VH-VL-P of G4H | artificial | nt | GAGGTGCAGCTGCTCGAGTCTGGAGGAGGATTGGTGCAGCCTGGAGGG<br>TCATTGAAACTCTCATGTGCAGCCTCTGGATTCACCTTCAATCGCTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGGGAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACTTATCCTACTTC<br>GCTTACTGGGGCCAAGGGACTCTGGTCACCGTCTCCTCAGGTGGTGGT<br>GGTTCTGGCGGCGGCGGCTCCGGTGGTGGTGGTTCTGAGCTCGTTGTG<br>ACTCAGGAACCTTCACTCACCGTATCACCTGGTGGAACAGTCACACTC<br>ACTTGTGGCTCCTCGACTGGGGCTGTTACATCTGGCTACTACCCAAAC<br>TGGGTCCAACAAAAACCAGGTCAGGCACCCCGTGGTCTAATAGGTGGG<br>ACTAAGTTCCTCGCCCCCGGTACTCCTGCCAGATTCTCAGGCTCCCTG<br>CTTGGAGGCAAGGCTGCCCTCACCCTCTCAGGGGTACAGCCAGAGGAT<br>GAGGCAGAATATTACTGTGCTCTATGGTACAGCAACCGCTGGGTGTTC<br>GGTGGAGGAACCAAACTGACTGTCCTA |
| 81. | CDR-L1 of A2J | artificial | aa | RSSTGAVTSGYYPN |
| 82. | CDR-L2 of A2J | artificial | aa | ATDMRPS |
| 83. | CDR-L3 of A2J | artificial | aa | ALWYSNRWV |
| 84. | CDR-H1 of A2J | artificial | aa | VYAMN |
| 85. | CDR-H2 of A2J | artificial | aa | RIRSKYNNYATYYADSVKK |
| 86. | CDR-H3 of A2J | artificial | aa | HGNFGNSYLSWWAY |
| 87. | VH of A2J | artificial | aa | EVQLVESGGGLVQPGGSLKLSCAASGFTFNVYAMNWVRQAPGKGLEWV<br>ARIRSKYNNYATYYADSVKKRFTISRDDSKNTAYLQMNNLKTEDTAVY<br>YCVRHGNFGNSYLSWWAYWGQGTLVTVSS |
| 88. | VH of A2J | artificial | nt | GAGGTGCAGCTGGTCGAGTCTGGAGGAGGATTGGTGCAGCCTGGAGGG<br>TCATTGAAACTCTCATGTGCAGCCTCTGGATTCACCTTCAATGTCTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAAAGAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACTTATCCTGGTGG<br>GCTTACTGGGGCCAAGGGACTCTGGTCACCGTCTCCTCA |
| 89. | VL of A2J | artificial | aa | QTVVTQEPSLTVSPGGTVTLTCRSSTGAVTSGYYPNWVQQKPGQAPRG<br>LIGATDMRPSGTPARFSGSLLGGKAALTLSGVQPEDEAEYYCALWYSN<br>RWVFGGGTKLTVL |
| 90. | VL of A2J | artificial | nt | CAGACTGTTGTGACTCAGGAACCTTCACTCACCGTATCACCTGGTGGA<br>ACAGTCACACTCACTTGTCGCTCCTCGACTGGGGCTGTTACATCTGGC<br>TACTACCCAAACTGGGTCCAACAAAAACCAGGTCAGGCACCCCGTGGT<br>CTAATAGGTGCCACTGACATGAGGCCCTCTGGTACTCCTGCCAGATTC<br>TCAGGCTCCCTGCTTGGAGGCAAGGCTGCCCTCACCCTCTCAGGGGTA<br>CAGCCAGAGGATGAGGCAGAATATTACTGTGCTCTATGGTACAGCAAC<br>CGCTGGGTGTTCGGTGGAGGAACCAAACTGACTGTCCTA |
| 91. | VH-P of A2J | artificial | aa | EVQLLESGGGLVQPGGSLKLSCAASGFTFNVYAMNWVRQAPGKGLEWV<br>ARIRSKYNNYATYYADSVKKRFTISRDDSKNTAYLQMNNLKTEDTAVY<br>YCVRHGNFGNSYLSWWAYWGQGTLVTVSS |
| 92. | VH-P of A2J | artificial | nt | GAGGTGCAGCTGCTCGAGTCTGGAGGAGGATTGGTGCAGCCTGGAGGG<br>TCATTGAAACTCTCATGTGCAGCCTCTGGATTCACCTTCAATGTCTAC |

| SEQ ID NO. | DESIGNATION | SOURCE | TYPE | SEQUENCE |
|---|---|---|---|---|
| | | | | GCCATGAACTGGGTCCGCCAGGCTCCAGGAAAGGGTTTGGAATGGGTT |
| | | | | GCTCGCATAAGAAGTAAATATAATAATTATGCAACATATTATGCCGAT |
| | | | | TCAGTGAAAAAGAGGTTCACCATCTCCAGAGATGATTCAAAAAACACT |
| | | | | GCCTATCTACAAATGAACAACTTGAAAACTGAGGACACTGCCGTGTAC |
| | | | | TACTGTGTGAGACATGGGAACTTCGGTAATAGCTACTTATCCTGGTGG |
| | | | | GCTTACTGGGGCCAAGGGACTCTGGTCACCGTCTCCTCA |
| 93. | VL-P of A2J | artificial | aa | ELVVTQEPSLTVSPGGTVTLTCRSSTGAVTSGYYPNWVQQKPGQAPRG |
| | | | | LIGATDMRPSGTPARFSGSLLGGKAALTLSGVQPEDEAEYYCALWYSN |
| | | | | RWVFGGGTKLTVL |
| 94. | VL-P of A2J | artificial | nt | GAGCTCGTTGTGACTCAGGAACCTTCACTCACCGTATCACCTGGTGGA |
| | | | | ACAGTCACACTCACTTGTCGCTCCTCGACTGGGGCTGTTACATCTGGC |
| | | | | TACTACCCAAACTGGGTCCAACAAAAACCAGGTCAGGCACCCCGTGGT |
| | | | | CTAATAGGTGCCACTGACATGAGGCCCTCTGGTACTCCTGCCAGATTC |
| | | | | TCAGGCTCCCTGCTTGGAGGCAAGGCTGCCCTCACCCTCTCAGGGGTA |
| | | | | CAGCCAGAGGATGAGGCAGAATATTACTGTGCTCTATGGTACAGCAAC |
| | | | | CGCTGGGTGTTCGGTGGAGGAACCAAACTGACTGTCCTA |
| 95. | VH-VL of A2J | artificial | aa | EVQLVESGGGLVQPGGSLKLSCAASGFTFNVYAMNWVRQAPGKGLEWV |
| | | | | ARIRSKYNNYATYYADSVKKRFTISRDDSKNTAYLQMNNLKTEDTAVY |
| | | | | YCVRHGNFGNSYLSWWAYWGQGTLVTVSSGGGGSGGGGSGGGGSQTVV |
| | | | | TQEPSLTVSPGGTVTLTCRSSTGAVTSGYYPNWVQQKPGQAPRGLIGA |
| | | | | TDMRPSGTPARFSGSLLGGKAALTLSGVQPEDEAEYYCALWYSNRWVF |
| | | | | GGGTKLTVL |
| 96. | VH-VL of A2J | artificial | nt | GAGGTGCAGCTGGTCGAGTCTGGAGGAGGATTGGTGCAGCCTGGAGGG |
| | | | | TCATTGAAACTCTCATGTGCAGCCTCTGGATTCACCTTCAATGTCTAC |
| | | | | GCCATGAACTGGGTCCGCCAGGCTCCAGGAAAGGGTTTGGAATGGGTT |
| | | | | GCTCGCATAAGAAGTAAATATAATAATTATGCAACATATTATGCCGAT |
| | | | | TCAGTGAAAAAGAGGTTCACCATCTCCAGAGATGATTCAAAAAACACT |
| | | | | GCCTATCTACAAATGAACAACTTGAAAACTGAGGACACTGCCGTGTAC |
| | | | | TACTGTGTGAGACATGGGAACTTCGGTAATAGCTACTTATCCTGGTGG |
| | | | | GCTTACTGGGGCCAAGGGACTCTGGTCACCGTCTCCTCAGGTGGTGGT |
| | | | | GGTTCTGGCGGCGGCGGCTCCGGTGGTGGTGGTTCTCAGACTGTTGTG |
| | | | | ACTCAGGAACCTTCACTCACCGTATCACCTGGTGGAACAGTCACACTC |
| | | | | ACTTGTCGCTCCTCGACTGGGGCTGTTACATCTGGCTACTACCCAAAC |
| | | | | TGGGTCCAACAAAAACCAGGTCAGGCACCCCGTGGTCTAATAGGTGCC |
| | | | | ACTGACATGAGGCCCTCTGGTACTCCTGCCAGATTCTCAGGCTCCCTG |
| | | | | CTTGGAGGCAAGGCTGCCCTCACCCTCTCAGGGGTACAGCCAGAGGAT |
| | | | | GAGGCAGAATATTACTGTGCTCTATGGTACAGCAACCGCTGGGTGTTC |
| | | | | GGTGGAGGAACCAAACTGACTGTCCTA |
| 97. | VH-VL-P of A2J | artificial | aa | EVQLLESGGGLVQPGGSLKLSCAASGFTFNVYAMNWVRQAPGKGLEWV |
| | | | | ARIRSKYNNYATYYADSVKKRFTISRDDSKNTAYLQMNNLKTEDTAVY |
| | | | | YCVRHGNFGNSYLSWWAYWGQGTLVTVSSGGGGSGGGGSGGGGSELVV |
| | | | | TQEPSLTVSPGGTVTLTCRSSTGAVTSGYYPNWVQQKPGQAPRGLIGA |
| | | | | TDMRPSGTPARFSGSLLGGKAALTLSGVQPEDEAEYYCALWYSNRWVF |
| | | | | GGGTKLTVL |
| 98. | VH-VL-P of A2J | artificial | nt | GAGGTGCAGCTGCTCGAGTCTGGAGGAGGATTGGTGCAGCCTGGAGGG |
| | | | | TCATTGAAACTCTCATGTGCAGCCTCTGGATTCACCTTCAATGTCTAC |
| | | | | GCCATGAACTGGGTCCGCCAGGCTCCAGGAAAGGGTTTGGAATGGGTT |
| | | | | GCTCGCATAAGAAGTAAATATAATAATTATGCAACATATTATGCCGAT |
| | | | | TCAGTGAAAAAGAGGTTCACCATCTCCAGAGATGATTCAAAAAACACT |
| | | | | GCCTATCTACAAATGAACAACTTGAAAACTGAGGACACTGCCGTGTAC |
| | | | | TACTGTGTGAGACATGGGAACTTCGGTAATAGCTACTTATCCTGGTGG |
| | | | | GCTTACTGGGGCCAAGGGACTCTGGTCACCGTCTCCTCAGGTGGTGGT |
| | | | | GGTTCTGGCGGCGGCGGCTCCGGTGGTGGTGGTTCTGAGCTCGTTGTG |
| | | | | ACTCAGGAACCTTCACTCACCGTATCACCTGGTGGAACAGTCACACTC |
| | | | | ACTTGTCGCTCCTCGACTGGGGCTGTTACATCTGGCTACTACCCAAAC |
| | | | | TGGGTCCAACAAAAACCAGGTCAGGCACCCCGTGGTCTAATAGGTGCC |
| | | | | ACTGACATGAGGCCCTCTGGTACTCCTGCCAGATTCTCAGGCTCCCTG |
| | | | | CTTGGAGGCAAGGCTGCCCTCACCCTCTCAGGGGTACAGCCAGAGGAT |
| | | | | GAGGCAGAATATTACTGTGCTCTATGGTACAGCAACCGCTGGGTGTTC |
| | | | | GGTGGAGGAACCAAACTGACTGTCCTA |
| 99. | CDR-L1 of E1L | artificial | aa | GSSTGAVTSGYYPN |
| 100. | CDR-L2 of E1L | artificial | aa | GTKFLAP |
| 101. | CDR-L3 of E1L | artificial | aa | ALWYSNRWV |
| 102. | CDR-H1 of E1L | artificial | aa | KYAMN |
| 103. | CDR-H2 of E1L | artificial | aa | RIRSKYNNYATYYADSVKS |

-continued

| SEQ ID NO. | DESIGNATION | SOURCE | TYPE | SEQUENCE |
|---|---|---|---|---|
| 104. | CDR-H3 of E1L | artificial | aa | HGNFGNSYTSYYAY |
| 105. | VH of E1L | artificial | aa | EVQLVESGGGLVQPGGSLKLSCAASGFTFNKYAMNWVRQAPGKGLEWV ARIRSKYNNYATYYADSVKSRFTISRDDSKNTAYLQMNNLKTEDTAVY YCVRHGNFGNSYTSYYAYWGQGTLVTVSS |
| 106. | VH of E1L | artificial | nt | GAGGTGCAGCTGGTCGAGTCTGGAGGAGGATTGGTGCAGCCTGGAGGG TCATTGAAACTCTCATGTGCAGCCTCTGGATTCACCTTCAATAAGTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAATCGAGGTTCACCATCTCCAGAGATGATTCAAAAAACACT GCCTATCTACAAATGAACAACTTGAAAACTGAGGACACTGCCGTGTAC TACTGTGTGAGACATGGGAACTTCGGTAATAGCTACACATCCTACTAC GCTTACTGGGGCCAAGGGACTCTGGTCACCGTCTCCTCA |
| 107. | VL of E1L | artificial | aa | QTVVTQEPSLTVSPGGTVTLTCGSSTGAVTSGYYPNWVQQKPGQAPRG LIGGTKFLAPGTPARFSGSLLGGKAALTLSGVQPEDEAEYYCALWYSN RWVFGGGTKLTVL |
| 108. | VL of E1L | artificial | nt | CAGACTGTTGTGACTCAGGAACCTTCACTCACCGTATCACCTGGTGGA ACAGTCACACTCACTTGTGGCTCCTCGACTGGGGCTGTTACATCTGGC TACTACCCAAACTGGGTCCAACAAAAACCAGGTCAGGCACCCCGTGGT CTAATAGGTGGGACTAAGTTCCTCGCCCCCGGTACTCCTGCCAGATTC TCAGGCTCCCTGCTTGGAGGCAAGGCTGCCCTCACCCTCTCAGGGGTA CAGCCAGAGGATGAGGCAGAATATTACTGTGCTCTATGGTACAGCAAC CGCTGGGTGTTCGGTGGAGGAACCAAACTGACTGTCCTA |
| 109. | VH-P of E1L | artificial | aa | EVQLLESGGGLVQPGGSLKLSCAASGFTFNKYAMNWVRQAPGKGLEWV ARIRSKYNNYATYYADSVKSRFTISRDDSKNTAYLQMNNLKTEDTAVY YCVRHGNFGNSYTSYYAYWGQGTLVTVSS |
| 110. | VH-P of E1L | artificial | nt | GAGGTGCAGCTGCTCGAGTCTGGAGGAGGATTGGTGCAGCCTGGAGGG TCATTGAAACTCTCATGTGCAGCCTCTGGATTCACCTTCAATAAGTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAATCGAGGTTCACCATCTCCAGAGATGATTCAAAAAACACT GCCTATCTACAAATGAACAACTTGAAAACTGAGGACACTGCCGTGTAC TACTGTGTGAGACATGGGAACTTCGGTAATAGCTACACATCCTACTAC GCTTACTGGGGCCAAGGGACTCTGGTCACCGTCTCCTCA |
| 111. | VL-P of E1L | artificial | aa | ELVVTQEPSLTVSPGGTVTLTCGSSTGAVTSGYYPNWVQQKPGQAPRG LIGGTKFLAPGTPARFSGSLLGGKAALTLSGVQPEDEAEYYCALWYSN RWVFGGGTKLTVL |
| 112. | VL-P of E1L | artificial | nt | GAGCTCGTTGTGACTCAGGAACCTTCACTCACCGTATCACCTGGTGGA ACAGTCACACTCACTTGTGGCTCCTCGACTGGGGCTGTTACATCTGGC TACTACCCAAACTGGGTCCAACAAAAACCAGGTCAGGCACCCCGTGGT CTAATAGGTGGGACTAAGTTCCTCGCCCCCGGTACTCCTGCCAGATTC TCAGGCTCCCTGCTTGGAGGCAAGGCTGCCCTCACCCTCTCAGGGGTA CAGCCAGAGGATGAGGCAGAATATTACTGTGCTCTATGGTACAGCAAC CGCTGGGTGTTCGGTGGAGGAACCAAACTGACTGTCCTA |
| 113. | VH-VL of E1L | artificial | aa | EVQLVESGGGLVQPGGSLKLSCAASGFTFNKYAMNWVRQAPGKGLEWV ARIRSKYNNYATYYADSVKSRFTISRDDSKNTAYLQMNNLKTEDTAVY YCVRHGNFGNSYTSYYAYWGQGTLVTVSSGGGGSGGGGSGGGGSQTVV TQEPSLTVSPGGTVTLTCGSSTGAVTSGYYPNWVQQKPGQAPRGLIGG TKFLAPGTPARFSGSLLGGKAALTLSGVQPEDEAEYYCALWYSNRWVF GGGTKLTVL |
| 114. | VH-VL of E1L | artificial | nt | GAGGTGCAGCTGGTCGAGTCTGGAGGAGGATTGGTGCAGCCTGGAGGG TCATTGAAACTCTCATGTGCAGCCTCTGGATTCACCTTCAATAAGTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAATCGAGGTTCACCATCTCCAGAGATGATTCAAAAAACACT GCCTATCTACAAATGAACAACTTGAAAACTGAGGACACTGCCGTGTAC TACTGTGTGAGACATGGGAACTTCGGTAATAGCTACACATCCTACTAC GCTTACTGGGGCCAAGGGACTCTGGTCACCGTCTCCTCAGGTGGTGGT GGTTCTGGCGGCGGCGGCTCCGGTGGTGGTGGTTCTCAGACTGTTGTG ACTCAGGAACCTTCACTCACCGTATCACCTGGTGGAACAGTCACACTC ACTTGTGGCTCCTCGACTGGGGCTGTTACATCTGGCTACTACCCAAAC TGGGTCCAACAAAAACCAGGTCAGGCACCCCGTGGTCTAATAGGTGGG ACTAAGTTCCTCGCCCCCGGTACTCCTGCCAGATTCTCAGGCTCCCTG CTTGGAGGCAAGGCTGCCCTCACCCTCTCAGGGGTACAGCCAGAGGAT GAGGCAGAATATTACTGTGCTCTATGGTACAGCAACCGCTGGGTGTTC GGTGGAGGAACCAAACTGACTGTCCTA |

| SEQ ID NO. | DESIGNATION | SOURCE | TYPE | SEQUENCE |
|---|---|---|---|---|
| 115. | VH-VL-P of E1L | artificial | aa | EVQLLESGGGLVQPGGSLKLSCAASGFTFNKYAMNWVRQAPGKGLEWV ARIRSKYNNYATYYADSVKSRFTISRDDSKNTAYLQMNNLKTEDTAVY YCVRHGNFGNSYTSYYAYWGQGTLVTVSSGGGGSGGGGSGGGGSELVV TQEPSLTVSPGGTVTLTCGSSTGAVTSGYYPNWVQQKPGQAPRGLIGG TKFLAPGTPARFSGSLLGGKAALTLSGVQPEDEAEYYCALWYSNRWVF GGGTKLTVL |
| 116. | VH-VL-P of E1L | artificial | nt | GAGGTGCAGCTGCTCGAGTCTGGAGGAGGATTGGTGCAGCCTGGAGGG TCATTGAAACTCTCATGTGCAGCCTCTGGATTCACCTTCAATAAGTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAATCGAGGTTCACCATCTCCAGAGATGATTCAAAAAACACT GCCTATCTACAAATGAACAACTTGAAAACTGAGGACACTGCCGTGTAC TACTGTGTGAGACATGGGAACTTCGGTAATAGCTACACATCCTACTAC GCTTACTGGGGCCAAGGGACTCTGGTCACCGTCTCCTCAGGTGGTGGT GGTTCTGGCGGCGGCGGCTCCGGTGGTGGTGGTTCTGAGCTCGTTGTG ACTCAGGAACCTTCACTCACCGTATCACCTGGTGGAACAGTCACACTC ACTTGTGGCTCCTCGACTGGGGCTGTTACATCTGGCTACTACCCAAAC TGGGTCCAACAAAAACCAGGTCAGGCACCCCGTGGTCTAATAGGTGGG ACTAAGTTCCTCGCCCCGGTACTCCTGCCAGATTCTCAGGCTCCCTG CTTGGAGGCAAGGCTGCCCTCACCCTCTCAGGGGTACAGCCAGAGGAT GAGGCAGAATATTACTGTGCTCTATGGTACAGCAACCGCTGGGTGTTC GGTGGAGGAACCAAACTGACTGTCCTA |
| 117. | CDR-L1 of E2M | artificial | aa | RSSTGAVTSGYYPN |
| 118. | CDR-L2 of E2M | artificial | aa | ATDMRPS |
| 119. | CDR-L3 of E2M | artificial | aa | ALWYSNRWV |
| 120. | CDR-H1 of E2M | artificial | aa | GYAMN |
| 121. | CDR-H2 of E2M | artificial | aa | RIRSKYNNYATYYADSVKE |
| 122. | CDR-H3 of E2M | artificial | aa | HRNFGNSYLSWFAY |
| 123. | VH of E2M | artificial | aa | EVQLVESGGGLVQPGGSLKLSCAASGFTFNGYAMNWVRQAPGKGLEWV ARIRSKYNNYATYYADSVKERFTISRDDSKNTAYLQMNNLKTEDTAVY YCVRHRNFGNSYLSWFAYWGQGTLVTVSS |
| 124. | VH of E2M | artificial | nt | GAGGTGCAGCTGGTCGAGTCTGGAGGAGGATTGGTGCAGCCTGGAGGG TCATTGAAACTCTCATGTGCAGCCTCTGGATTCACCTTCAATGGCTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAAGAGAGGTTCACCATCTCCAGAGATGATTCAAAAAACACT GCCTATCTACAAATGAACAACTTGAAAACTGAGGACACTGCCGTGTAC TACTGTGTGAGACATAGGAACTTCGGTAATAGCTACTTATCCTGGTTC GCTTACTGGGGCCAAGGGACTCTGGTCACCGTCTCCTCA |
| 125. | VL of E2M | artificial | aa | QTVVTQEPSLTVSPGGTVTLTCRSSTGAVTSGYYPNWVQQKPGQAPRG LIGATDMRPSGTPARFSGSLLGGKAALTLSGVQPEDEAEYYCALWYSN RWVFGGGTKLTVL |
| 126. | VL of E2M | artificial | nt | CAGACTGTTGTGACTCAGGAACCTTCACTCACCGTATCACCTGGTGGA ACAGTCACACTCACTTGTCGCTCCTCGACTGGGGCTGTTACATCTGGC TACTACCCAAACTGGGTCCAACAAAAACCAGGTCAGGCACCCCGTGGT CTAATAGGTGCCACTGACATGAGGCCCTCTGGTACTCCTGCCAGATTC TCAGGCTCCCTGCTTGGAGGCAAGGCTGCCCTCACCCTCTCAGGGGTA CAGCCAGAGGATGAGGCAGAATATTACTGTGCTCTATGGTACAGCAAC CGCTGGGTGTTCGGTGGAGGAACCAAACTGACTGTCCTA |
| 127. | VH-P of E2M | artificial | aa | EVQLLESGGGLVQPGGSLKLSCAASGFTFNGYAMNWVRQAPGKGLEWV ARIRSKYNNYATYYADSVKERFTISRDDSKNTAYLQMNNLKTEDTAVY YCVRHRNFGNSYLSWFAYWGQGTLVTVSS |
| 128. | VH-P of E2M | artificial | nt | GAGGTGCAGCTGCTCGAGTCTGGAGGAGGATTGGTGCAGCCTGGAGGG TCATTGAAACTCTCATGTGCAGCCTCTGGATTCACCTTCAATGGCTAC GCCATGAACTGGGTCCGCCAGGCTCCAGGAAAGGGTTTGGAATGGGTT GCTCGCATAAGAAGTAAATATAATAATTATGCAACATATTATGCCGAT TCAGTGAAAGAGAGGTTCACCATCTCCAGAGATGATTCAAAAAACACT GCCTATCTACAAATGAACAACTTGAAAACTGAGGACACTGCCGTGTAC TACTGTGTGAGACATAGGAACTTCGGTAATAGCTACTTATCCTGGTTC GCTTACTGGGGCCAAGGGACTCTGGTCACCGTCTCCTCA |

-continued

| SEQ ID NO. | DESIGNATION | SOURCE | TYPE | SEQUENCE |
|---|---|---|---|---|
| 129. | VL-P of E2M | artificial | aa | ELVVTQEPSLTVSPGGTVTLTCRSSTGAVTSGYYPNWVQQKPGQAPRG<br>LIGATDMRPSGTPARFSGSLLGGKAALTLSGVQPEDEAEYYCALWYSN<br>RWVFGGGTKLTVL |
| 130. | VL-P of E2M | artificial | nt | GAGCTCGTTGTGACTCAGGAACCTTCACTCACCGTATCACCTGGTGGA<br>ACAGTCACACTCACTTGTCGCTCCTCGACTGGGGCTGTTACATCTGGC<br>TACTACCCAAACTGGGTCCAACAAAAACCAGGTCAGGCACCCCGTGGT<br>CTAATAGGTGCCACTGACATGAGGCCCTCTGGTACTCCTGCCAGATTC<br>TCAGGCTCCCTGCTTGGAGGCAAGGCTGCCCTCACCCTCTCAGGGGTA<br>CAGCCAGAGGATGAGGCAGAATATTACTGTGCTCTATGGTACAGCAAC<br>CGCTGGGTGTTCGGTGGAGGAACCAAACTGACTGTCCTA |
| 131. | VH-VL of E2M | artificial | aa | EVQLVESGGGLVQPGGSLKLSCAASGFTFNGYAMNWVRQAPGKGLEWV<br>ARIRSKYNNYATYYADSVKERFTISRDDSKNTAYLQMNNLKTEDTAVY<br>YCVRHRNFGNSYLSWFAYWGQGTLVTVSSGGGGSGGGGSGGGGSQTVV<br>TQEPSLTVSPGGTVTLTCRSSTGAVTSGYYPNWVQQKPGQAPRGLIGA<br>TDMRPSGTPARFSGSLLGGKAALTLSGVQPEDEAEYYCALWYSNRWVF<br>GGGTKLTVL |
| 132. | VH-VL of E2M | artificial | nt | GAGGTGCAGCTGGTCGAGTCTGGAGGAGGATTGGTGCAGCCTGGAGGG<br>TCATTGAAACTCTCATGTGCAGCCTCTGGATTCACCTTCAATGGCTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGAGAGGTTCACCATCTCCAGAGATGATTCAAAAAACACT<br>GCCTATCTACAAATGAACAACTTGAAAACTGAGGACACTGCCGTGTAC<br>TACTGTGTGAGACATAGGAACTTCGGTAATAGCTACTTATCCTGGTTC<br>GCTTACTGGGGCCAAGGGACTCTGGTCACCGTCTCCTCAGGTGGTGGT<br>GGTTCTGGCGGCGGCGGCTCCGGTGGTGGTGGTTCTCAGACTGTTGTG<br>ACTCAGGAACCTTCACTCACCGTATCACCTGGTGGAACAGTCACACTC<br>ACTTGTCGCTCCTCGACTGGGGCTGTTACATCTGGCTACTACCCAAAC<br>TGGGTCCAACAAAAACCAGGTCAGGCACCCCGTGGTCTAATAGGTGCC<br>ACTGACATGAGGCCCTCTGGTACTCCTGCCAGATTCTCAGGCTCCCTG<br>CTTGGAGGCAAGGCTGCCCTCACCCTCTCAGGGGTACAGCCAGAGGAT<br>GAGGCAGAATATTACTGTGCTCTATGGTACAGCAACCGCTGGGTGTTC<br>GGTGGAGGAACCAAACTGACTGTCCTA |
| 133. | VH-VL-P of E2M | artificial | aa | EVQLLESGGGLVQPGGSLKLSCAASGFTFNGYAMNWVRQAPGKGLEWV<br>ARIRSKYNNYATYYADSVKERFTISRDDSKNTAYLQMNNLKTEDTAVY<br>YCVRHRNFGNSYLSWFAYWGQGTLVTVSSGGGGSGGGGSGGGGSELVV<br>TQEPSLTVSPGGTVTLTCRSSTGAVTSGYYPNWVQQKPGQAPRGLIGA<br>TDMRPSGTPARFSGSLLGGKAALTLSGVQPEDEAEYYCALWYSNRWVF<br>GGGTKLTVL |
| 134. | VH-VL-P of E2M | artificial | nt | GAGGTGCAGCTGCTCGAGTCTGGAGGAGGATTGGTGCAGCCTGGAGGG<br>TCATTGAAACTCTCATGTGCAGCCTCTGGATTCACCTTCAATGGCTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGAGAGGTTCACCATCTCCAGAGATGATTCAAAAAACACT<br>GCCTATCTACAAATGAACAACTTGAAAACTGAGGACACTGCCGTGTAC<br>TACTGTGTGAGACATAGGAACTTCGGTAATAGCTACTTATCCTGGTTC<br>GCTTACTGGGGCCAAGGGACTCTGGTCACCGTCTCCTCAGGTGGTGGT<br>GGTTCTGGCGGCGGCGGCTCCGGTGGTGGTGGTTCTGAGCTCGTTGTG<br>ACTCAGGAACCTTCACTCACCGTATCACCTGGTGGAACAGTCACACTC<br>ACTTGTCGCTCCTCGACTGGGGCTGTTACATCTGGCTACTACCCAAAC<br>TGGGTCCAACAAAAACCAGGTCAGGCACCCCGTGGTCTAATAGGTGCC<br>ACTGACATGAGGCCCTCTGGTACTCCTGCCAGATTCTCAGGCTCCCTG<br>CTTGGAGGCAAGGCTGCCCTCACCCTCTCAGGGGTACAGCCAGAGGAT<br>GAGGCAGAATATTACTGTGCTCTATGGTACAGCAACCGCTGGGTGTTC<br>GGTGGAGGAACCAAACTGACTGTCCTA |
| 135. | CDR-L1 of F70 | artificial | aa | GSSTGAVTSGYYPN |
| 136. | CDR-L2 of F70 | artificial | aa | GTKFLAP |
| 137. | CDR-L3 of F70 | artificial | aa | ALWYSNRWV |
| 138. | CDR-H1 of F70 | artificial | aa | VYAMN |
| 139. | CDR-H2 of F70 | artificial | aa | RIRSKYNNYATYYADSVKK |
| 140. | CDR-H3 of F70 | artificial | aa | HGNFGNSYISWWAY |
| 141. | VH of F70 | artificial | aa | EVQLVESGGGLVQPGGSLKLSCAASGFTFNVYAMNWVRQAPGKGLEWV<br>ARIRSKYNNYATYYADSVKKRFTISRDDSKNTAYLQMNNLKTEDTAVY<br>YCVRHGNFGNSYISWWAYWGQGTLVTVSS |

| SEQ ID NO. | DESIGNATION | SOURCE | TYPE | SEQUENCE |
|---|---|---|---|---|
| 142. | VH of F70 | artificial | nt | GAGGTGCAGCTGGTCGAGTCTGGAGGAGGATTGGTGCAGCCTGGAGGG<br>TCATTGAAACTCTCATGTGCAGCCTCTGGATTCACCTTCAATGTGTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAAGAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACATATCCTGGTGG<br>GCTTACTGGGGCCAAGGGACTCTGGTCACCGTCTCCTCA |
| 143. | VL of F70 | artificial | aa | QTVVTQEPSLTVSPGGTVTLTCGSSTGAVTSGYYPNWVQQKPGQAPRG<br>LIGGTKFLAPGTPARFSGSLLGGKAALTLSGVQPEDEAEYYCALWYSN<br>RWVFGGGTKLTVL |
| 144. | VL of F70 | artificial | nt | CAGACTGTTGTGACTCAGGAACCTTCACTCACCGTATCACCTGGTGGA<br>ACAGTCACACTCACTTGTGGCTCCTCGACTGGGGCTGTTACATCTGGC<br>TACTACCCAAACTGGGTCCAACAAAAACCAGGTCAGGCACCCCGTGGT<br>CTAATAGGTGGGACTAAGTTCCTCGCCCCCGGTACTCCTGCCAGATTC<br>TCAGGCTCCCTGCTTGGAGGCAAGGCTGCCCTCACCCTCTCAGGGGTA<br>CAGCCAGAGGATGAGGCAGAATATTACTGTGCTCTATGGTACAGCAAC<br>CGCTGGGTGTTCGGTGGAGGAACCAAACTGACTGTCCTA |
| 145. | VH-P of F70 | artificial | aa | EVQLLESGGGLVQPGGSLKLSCAASGFTFNVYAMNWVRQAPGKGLEWV<br>ARIRSKYNNYATYYADSVKKRFTISRDDSKNTAYLQMNNLKTEDTAVY<br>YCVRHGNFGNSYISWWAYWGQGTLVTVSS |
| 146. | VH-P of F70 | artificial | nt | GAGGTGCAGCTGCTCGAGTCTGGAGGAGGATTGGTGCAGCCTGGAGGG<br>TCATTGAAACTCTCATGTGCAGCCTCTGGATTCACCTTCAATGTGTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAAGAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACATATCCTGGTGG<br>GCTTACTGGGGCCAAGGGACTCTGGTCACCGTCTCCTCA |
| 147. | VL-P of F70 | artificial | aa | ELVVTQEPSLTVSPGGTVTLTCGSSTGAVTSGYYPNWVQQKPGQAPRG<br>LIGGTKFLAPGTPARFSGSLLGGKAALTLSGVQPEDEAEYYCALWYSN<br>RWVFGGGTKLTVL |
| 148. | VL-P of F70 | artificial | nt | GAGCTCGTTGTGACTCAGGAACCTTCACTCACCGTATCACCTGGTGGA<br>ACAGTCACACTCACTTGTGGCTCCTCGACTGGGGCTGTTACATCTGGC<br>TACTACCCAAACTGGGTCCAACAAAAACCAGGTCAGGCACCCCGTGGT<br>CTAATAGGTGGGACTAAGTTCCTCGCCCCCGGTACTCCTGCCAGATTC<br>TCAGGCTCCCTGCTTGGAGGCAAGGCTGCCCTCACCCTCTCAGGGGTA<br>CAGCCAGAGGATGAGGCAGAATATTACTGTGCTCTATGGTACAGCAAC<br>CGCTGGGTGTTCGGTGGAGGAACCAAACTGACTGTCCTA |
| 149. | VH-VL of F70 | artificial | aa | EVQLVESGGGLVQPGGSLKLSCAASGFTFNVYAMNWVRQAPGKGLEWV<br>ARIRSKYNNYATYYADSVKKRFTISRDDSKNTAYLQMNNLKTEDTAVY<br>YCVRHGNFGNSYISWWAYWGQGTLVTVSSGGGGSGGGGSGGGGSQTVV<br>TQEPSLTVSPGGTVTLTCGSSTGAVTSGYYPNWVQQKPGQAPRGLIGG<br>TKFLAPGTPARFSGSLLGGKAALTLSGVQPEDEAEYYCALWYSNRWVF<br>GGGTKLTVL |
| 150. | VH-VL of F70 | artificial | nt | GAGGTGCAGCTGGTCGAGTCTGGAGGAGGATTGGTGCAGCCTGGAGGG<br>TCATTGAAACTCTCATGTGCAGCCTCTGGATTCACCTTCAATGTGTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAAGAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACATATCCTGGTGG<br>GCTTACTGGGGCCAAGGGACTCTGGTCACCGTCTCCTCAGGTGGTGGT<br>GGTTCTGGCGGCGGCGGCTCCGGTGGTGGTGGTTCTCAGACTGTTGTG<br>ACTCAGGAACCTTCACTCACCGTATCACCTGGTGGAACAGTCACACTC<br>ACTTGTGGCTCCTCGACTGGGGCTGTTACATCTGGCTACTACCCAAAC<br>TGGGTCCAACAAAAACCAGGTCAGGCACCCCGTGGTCTAATAGGTGGG<br>ACTAAGTTCCTCGCCCCCGGTACTCCTGCCAGATTCTCAGGCTCCCTG<br>CTTGGAGGCAAGGCTGCCCTCACCCTCTCAGGGGTACAGCCAGAGGAT<br>GAGGCAGAATATTACTGTGCTCTATGGTACAGCAACCGCTGGGTGTTC<br>GGTGGAGGAACCAAACTGACTGTCCTA |
| 151. | VH-VL-P of F70 | artificial | aa | EVQLLESGGGLVQPGGSLKLSCAASGFTFNVYAMNWVRQAPGKGLEWV<br>ARIRSKYNNYATYYADSVKKRFTISRDDSKNTAYLQMNNLKTEDTAVY<br>YCVRHGNFGNSYISWWAYWGQGTLVTVSSGGGGSGGGGSGGGGSELVV<br>TQEPSLTVSPGGTVTLTCGSSTGAVTSGYYPNWVQQKPGQAPRGLIGG<br>TKFLAPGTPARFSGSLLGGKAALTLSGVQPEDEAEYYCALWYSNRWVF<br>GGGTKLTVL |

| SEQ ID NO. | DESIGNATION | SOURCE | TYPE | SEQUENCE |
|---|---|---|---|---|
| 152. | VH-VL-P of F70 | artificial | nt | GAGGTGCAGCTGCTCGAGTCTGGAGGAGGATTGGTGCAGCCTGGAGGG<br>TCATTGAAACTCTCATGTGCAGCCTCTGGATTCACCTTCAATGTGTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAAGAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACATATCCTGGTGG<br>GCTTACTGGGGCCAAGGGACTCTGGTCACCGTCTCCTCAGGTGGTGGT<br>GGTTCTGGCGGCGGCGGCTCCGGTGGTGGTGGTTCTGAGCTCGTTGTG<br>ACTCAGGAACCTTCACTCACCGTATCACCTGGTGGAACAGTCACACTC<br>ACTTGTGGCTCCTCGACTGGGGCTGTTACATCTGGCTACTACCCAAAC<br>TGGGTCCAACAAAAACCAGGTCAGGCACCCCGTGGTCTAATAGGTGGG<br>ACTAAGTTCCTCGCCCCCGGTACTCCTGCCAGATTCTCAGGCTCCCTG<br>CTTGGAGGCAAGGCTGCCCTCACCCTCTCAGGGGTACAGCCAGAGGAT<br>GAGGCAGAATATTACTGTGTCTATGGTACAGCAACCGCTGGGTGTTC<br>GGTGGAGGAACCAAACTGACTGTCCTA |
| 153. | CDR-L1 of F12Q | artificial | aa | GSSTGAVTSGNYPN |
| 154. | CDR-L2 of F12Q | artificial | aa | GTKFLAP |
| 155. | CDR-L3 of F12Q | artificial | aa | VLWYSNRWV |
| 156. | CDR-H1 of F12Q | artificial | aa | SYAMN |
| 157. | CDR-H2 of F12Q | artificial | aa | RIRSKYNNYATYYADSVKG |
| 158. | CDR-H3 of F12Q | artificial | aa | HGNFGNSYVSWWAY |
| 159. | VH of F12Q | artificial | aa | EVQLVESGGGLVQPGGSLKLSCAASGFTFNSYAMNWVRQAPGKGLEWV<br>ARIRSKYNNYATYYADSVKGRFTISRDDSKNTAYLQMNNLKTEDTAVY<br>YCVRHGNFGNSYVSWWAYWGQGTLVTVSS |
| 160. | VH of F12Q | artificial | nt | GAGGTGCAGCTGGTCGAGTCTGGAGGAGGATTGGTGCAGCCTGGAGGG<br>TCATTGAAACTCTCATGTGCAGCCTCTGGATTCACCTTCAATAGCTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGGCAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACGTTTCCTGGTGG<br>GCTTACTGGGGCCAAGGGACTCTGGTCACCGTCTCCTCA |
| 161. | VL of F12Q | artificial | aa | QTVVTQEPSLTVSPGGTVTLTCGSSTGAVTSGNYPNWVQQKPGQAPRG<br>LIGGTKFLAPGTPARFSGSLLGGKAALTLSGVQPEDEAEYYCVLWYSN<br>RWVFGGGTKLTVL |
| 162. | VL of F12Q | artificial | nt | CAGACTGTTGTGACTCAGGAACCTTCACTCACCGTATCACCTGGTGGA<br>ACAGTCACACTCACTTGTGGCTCCTCGACTGGGGCTGTTACATCTGGC<br>AACTACCCAAACTGGGTCCAACAAAAACCAGGTCAGGCACCCCGTGGT<br>CTAATAGGTGGGACTAAGTTCCTCGCCCCCGGTACTCCTGCCAGATTC<br>TCAGGCTCCCTGCTTGGAGGCAAGGCTGCCCTCACCCTCTCAGGGGTA<br>CAGCCAGAGGATGAGGCAGAATATTACTGTGTTCTATGGTACAGCAAC<br>CGCTGGGTGTTCGGTGGAGGAACCAAACTGACTGTCCTA |
| 163. | VH-P of F12Q | artificial | aa | EVQLLESGGGLVQPGGSLKLSCAASGFTFNSYAMNWVRQAPGKGLEWV<br>ARIRSKYNNYATYYADSVKGRFTISRDDSKNTAYLQMNNLKTEDTAVY<br>YCVRHGNFGNSYVSWWAYWGQGTLVTVSS |
| 164. | VH-P of F12Q | artificial | nt | GAGGTGCAGCTGCTCGAGTCTGGAGGAGGATTGGTGCAGCCTGGAGGG<br>TCATTGAAACTCTCATGTGCAGCCTCTGGATTCACCTTCAATAGCTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGGCAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACGTTTCCTGGTGG<br>GCTTACTGGGGCCAAGGGACTCTGGTCACCGTCTCCTCA |
| 165. | VL-P of F12Q | artificial | aa | ELVVTQEPSLTVSPGGTVTLTCGSSTGAVTSGNYPNWVQQKPGQAPRG<br>LIGGTKFLAPGTPARFSGSLLGGKAALTLSGVQPEDEAEYYCVLWYSN<br>RWVFGGGTKLTVL |
| 166. | VL-P of F12Q | artificial | nt | GAGCTCGTTGTGACTCAGGAACCTTCACTCACCGTATCACCTGGTGGA<br>ACAGTCACACTCACTTGTGGCTCCTCGACTGGGGCTGTTACATCTGGC<br>AACTACCCAAACTGGGTCCAACAAAAACCAGGTCAGGCACCCCGTGGT<br>CTAATAGGTGGGACTAAGTTCCTCGCCCCCGGTACTCCTGCCAGATTC<br>TCAGGCTCCCTGCTTGGAGGCAAGGCTGCCCTCACCCTCTCAGGGGTA |

| SEQ ID NO. | DESIGNATION | SOURCE | TYPE | SEQUENCE |
|---|---|---|---|---|
| | | | | CAGCCAGAGGATGAGGCAGAATATTACTGTGTTCTATGGTACAGCAAC<br>CGCTGGGTGTTCGGTGGAGGAACCAAACTGACTGTCCTA |
| 167. | VH-VL of F12Q | artificial | aa | EVQLVESGGGLVQPGGSLKLSCAASGFTFNSYAMNWVRQAPGKGLEWV<br>ARIRSKYNNYATYYADSVKGRFTISRDDSKNTAYLQMNNLKTEDTAVY<br>YCVRHGNFGNSYVSWWAYWGQGTLVTVSSGGGGSGGGGSGGGGSQTVV<br>TQEPSLTVSPGGTVTLTCGSSTGAVTSGNYPNWVQQKPGQAPRGLIGG<br>TKFLAPGTPARFSGSLLGGKAALTLSGVQPEDEAEYYCVLWYSNRWVF<br>GGGTKLTVL |
| 168. | VH-VL of F12Q | artificial | nt | GAGGTGCAGCTGGTCGAGTCTGGAGGAGGATTGGTGCAGCCTGGAGGG<br>TCATTGAAACTCTCATGTGCAGCCTCTGGATTCACCTTCAATAGCTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGGCAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACGTTTCCTGGTGG<br>GCTTACTGGGGCCAAGGGACTCTGGTCACCGTCTCCTCAGGTGGTGGT<br>GGTTCTGGCGGCGGCGGCTCCGGTGGTGGTGGTTCTCAGACTGTTGTG<br>ACTCAGGAACCTTCACTCACCGTATCCACCTGGTGGAACAGTCACACTC<br>ACTTGTGGCTCCTCGACTGGGGCTGTTACATCTGGCAACTACCCAAAC<br>TGGGTCCAACAAAAACCAGGTCAGGCACCCCGTGGTCTAATAGGTGGG<br>ACTAAGTTCCTCGCCCCGGTACTCCTGCCAGATTCTCAGGCTCCCTG<br>CTTGGAGGCAAGGCTGCCCTCACCCTCTCAGGGGTACAGCCAGAGGAT<br>GAGGCAGAATATTACTGTGTTCTATGGTACAGCAACCGCTGGGTGTTC<br>GGTGGAGGAACCAAACTGACTGTCCTA |
| 169. | VH-VL-P of F12Q | artificial | aa | EVQLLESGGGLVQPGGSLKLSCAASGFTFNSYAMNWVRQAPGKGLEWV<br>ARIRSKYNNYATYYADSVKGRFTISRDDSKNTAYLQMNNLKTEDTAVY<br>YCVRHGNFGNSYVSWWAYWGQGTLVTVSSGGGGSGGGGSGGGGSELVV<br>TQEPSLTVSPGGTVTLTCGSSTGAVTSGNYPNWVQQKPGQAPRGLIGG<br>TKFLAPGTPARFSGSLLGGKAALTLSGVQPEDEAEYYCVLWYSNRWVF<br>GGGTKLTVL |
| 170. | VH-VL-P of F12Q | artificial | nt | GAGGTGCAGCTGCTCGAGTCTGGAGGAGGATTGGTGCAGCCTGGAGGG<br>TCATTGAAACTCTCATGTGCAGCCTCTGGATTCACCTTCAATAGCTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGGCAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACGTTTCCTGGTGG<br>GCTTACTGGGGCCAAGGGACTCTGGTCACCGTCTCCTCAGGTGGTGGT<br>GGTTCTGGCGGCGGCGGCTCCGGTGGTGGTGGTTCTGAGCTCGTTGTG<br>ACTCAGGAACCTTCACTCACCGTATCACCTGGTGGAACAGTCACACTC<br>ACTTGTGGCTCCTCGACTGGGGCTGTTACATCTGGCAACTACCCAAAC<br>TGGGTCCAACAAAAACCAGGTCAGGCACCCCGTGGTCTAATAGGTGGG<br>ACTAAGTTCCTCGCCCCGGTACTCCTGCCAGATTCTCAGGCTCCCTG<br>CTTGGAGGCAAGGCTGCCCTCACCCTCTCAGGGGTACAGCCAGAGGAT<br>GAGGCAGAATATTACTGTGTTCTATGGTACAGCAACCGCTGGGTGTTC<br>GGTGGAGGAACCAAACTGACTGTCCTA |
| 171. | CDR-L1 of I2C | artificial | aa | GSSTGAVTSGNYPN |
| 172. | CDR-L2 of I2C | artificial | aa | GTKFLAP |
| 173. | CDR-L3 of I2C | artificial | aa | VLWYSNRWV |
| 174. | CDR-H1 of I2C | artificial | aa | KYAMN |
| 175. | CDR-H2 of I2C | artificial | aa | RIRSKYNNYATYYADSVKD |
| 176. | CDR-H3 of I2C | artificial | aa | HGNFGNSYISYWAY |
| 177. | VH of I2C | artificial | aa | EVQLVESGGGLVQPGGSLKLSCAASGFTFNKYAMNWVRQAPGKGLEWV<br>ARIRSKYNNYATYYADSVKDRFTISRDDSKNTAYLQMNNLKTEDTAVY<br>YCVRHGNFGNSYISYWAYWGQGTLVTVSS |
| 178. | VH of I2C | artificial | nt | GAGGTGCAGCTGGTCGAGTCTGGAGGAGGATTGGTGCAGCCTGGAGGG<br>TCATTGAAACTCTCATGTGCAGCCTCTGGATTCACCTTCAATAAGTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGACAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACATATCCTACTGG<br>GCTTACTGGGGCCAAGGGACTCTGGTCACCGTCTCCTCA |

| SEQ ID NO. | DESIGNATION | SOURCE | TYPE | SEQUENCE |
|---|---|---|---|---|
| 179. | VL of I2C | artificial | aa | QTVVTQEPSLTVSPGGTVTLTCGSSTGAVTSGNYPNWVQQKPGQAPRG<br>LIGGTKFLAPGTPARFSGSLLGGKAALTLSGVQPEDEAEYYCVLWYSN<br>RWVFGGGTKLTVL |
| 180. | VL of I2C | artificial | nt | CAGACTGTTGTGACTCAGGAACCTTCACTCACCGTATCACCTGGTGGA<br>ACAGTCACACTCACTTGTGGCTCCTCGACTGGGGCTGTTACATCTGGC<br>AACTACCCAAACTGGGTCCAACAAAAACCAGGTCAGGCACCCCGTGGT<br>CTAATAGGTGGGACTAAGTTCCTCGCCCCCGGTACTCCTGCCAGATTC<br>TCAGGCTCCCTGCTTGGAGGCAAGGCTGCCCTCACCCTCTCAGGGGTA<br>CAGCCAGAGGATGAGGCAGAATATTACTGTGTTCTATGGTACAGCAAC<br>CGCTGGGTGTTCGGTGGAGGAACCAAACTGACTGTCCTA |
| 181. | VH-P of I2C | artificial | aa | EVQLLESGGGLVQPGGSLKLSCAASGFTFNKYAMNWVRQAPGKGLEWV<br>ARIRSKYNNYATYYADSVKDRFTISRDDSKNTAYLQMNNLKTEDTAVY<br>YCVRHGNFGNSYISYWAYWGQGTLVTVSS |
| 182. | VH-P of I2C | artificial | nt | GAGGTGCAGCTGCTCGAGTCTGGAGGAGGATTGGTGCAGCCTGGAGGG<br>TCATTGAAACTCTCATGTGCAGCCTCTGGATTCACCTTCAATAAGTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGACAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACATATCCTACTGG<br>GCTTACTGGGGCCAAGGGACTCTGGTCACCGTCTCCTCA |
| 183. | VL-P of I2C | artificial | aa | ELVVTQEPSLTVSPGGTVTLTCGSSTGAVTSGNYPNWVQQKPGQAPRG<br>LIGGTKFLAPGTPARFSGSLLGGKAALTLSGVQPEDEAEYYCVLWYSN<br>RWVFGGGTKLTVL |
| 184. | VL-P of I2C | artificial | nt | GAGCTCGTTGTGACTCAGGAACCTTCACTCACCGTATCACCTGGTGGA<br>ACAGTCACACTCACTTGTGGCTCCTCGACTGGGGCTGTTACATCTGGC<br>AACTACCCAAACTGGGTCCAACAAAAACCAGGTCAGGCACCCCGTGGT<br>CTAATAGGTGGGACTAAGTTCCTCGCCCCCGGTACTCCTGCCAGATTC<br>TCAGGCTCCCTGCTTGGAGGCAAGGCTGCCCTCACCCTCTCAGGGGTA<br>CAGCCAGAGGATGAGGCAGAATATTACTGTGTTCTATGGTACAGCAAC<br>CGCTGGGTGTTCGGTGGAGGAACCAAACTGACTGTCCTA |
| 185. | VH-VL of I2C | artificial | aa | EVQLVESGGGLVQPGGSLKLSCAASGFTFNKYAMNWVRQAPGKGLEWV<br>ARIRSKYNNYATYYADSVKDRFTISRDDSKNTAYLQMNNLKTEDTAVY<br>YCVRHGNFGNSYISYWAYWGQGTLVTVSSGGGGSGGGGSGGGGSQTVV<br>TQEPSLTVSPGGTVTLTCGSSTGAVTSGNYPNWVQQKPGQAPRGLIGG<br>TKFLAPGTPARFSGSLLGGKAALTLSGVQPEDEAEYYCVLWYSNRWVF<br>GGGTKLTVL |
| 186. | VH-VL of I2C | artificial | nt | GAGGTGCAGCTGGTCGAGTCTGGAGGAGGATTGGTGCAGCCTGGAGGG<br>TCATTGAAACTCTCATGTGCAGCCTCTGGATTCACCTTCAATAAGTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGACAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACATATCCTACTGG<br>GCTTACTGGGGCCAAGGGACTCTGGTCACCGTCTCCTCAGGTGGTGGT<br>GGTTCTGGCGGCGGCGGCTCCGGTGGTGGTGGTTCTCAGACTGTTGTG<br>ACTCAGGAACCTTCACTCACCGTATCACCTGGTGGAACAGTCACACTC<br>ACTTGTGGCTCCTCGACTGGGGCTGTTACATCTGGCAACTACCCAAAC<br>TGGGTCCAACAAAAACCAGGTCAGGCACCCCGTGGTCTAATAGGTGGG<br>ACTAAGTTCCTCGCCCCCGGTACTCCTGCCAGATTCTCAGGCTCCCTG<br>CTTGGAGGCAAGGCTGCCCTCACCCTCTCAGGGGTACAGCCAGAGGAT<br>GAGGCAGAATATTACTGTGTTCTATGGTACAGCAACCGCTGGGTGTTC<br>GGTGGAGGAACCAAACTGACTGTCCTA |
| 187. | VH-VL-P of I2C | artificial | aa | EVQLLESGGGLVQPGGSLKLSCAASGFTFNKYAMNWVRQAPGKGLEWV<br>ARIRSKYNNYATYYADSVKDRFTISRDDSKNTAYLQMNNLKTEDTAVY<br>YCVRHGNFGNSYISYWAYWGQGTLVTVSSGGGGSGGGGSGGGGSELVV<br>TQEPSLTVSPGGTVTLTCGSSTGAVTSGNYPNWVQQKPGQAPRGLIGG<br>TKFLAPGTPARFSGSLLGGKAALTLSGVQPEDEAEYYCVLWYSNRWVF<br>GGGTKLTVL |
| 188. | VH-VL-P of I2C | artificial | nt | GAGGTGCAGCTGCTCGAGTCTGGAGGAGGATTGGTGCAGCCTGGAGGG<br>TCATTGAAACTCTCATGTGCAGCCTCTGGATTCACCTTCAATAAGTAC<br>GCCATGAACTGGGTCCGCCAGGCTCCAGGAAAGGGTTTGGAATGGGTT<br>GCTCGCATAAGAAGTAAATATAATAATTATGCAACATATTATGCCGAT<br>TCAGTGAAAGACAGGTTCACCATCTCCAGAGATGATTCAAAAAACACT<br>GCCTATCTACAAATGAACAACTTGAAAACTGAGGACACTGCCGTGTAC<br>TACTGTGTGAGACATGGGAACTTCGGTAATAGCTACATATCCTACTGG<br>GCTTACTGGGGCCAAGGGACTCTGGTCACCGTCTCCTCAGGTGGTGGT |

| SEQ ID NO. | DESIGNATION | SOURCE | TYPE | SEQUENCE |
|---|---|---|---|---|
| | | | | GGTTCTGGCGGCGGCGGCTCCGGTGGTGGTGGTTCTGAGCTCGTTGTG<br>ACTCAGGAACCTTCACTCACCGTATCACCTGGTGGAACAGTCACACTC<br>ACTTGTGGCTCCTCGACTGGGGCTGTTACATCTGGCAACTACCCAAAC<br>TGGGTCCAACAAAAACCAGGTCAGGCACCCCGTGGTCTAATAGGTGGG<br>ACTAAGTTCCTCGCCCCCGGTACTCCTGCCAGATTCTCAGGCTCCCTG<br>CTTGGAGGCAAGGCTGCCCTCACCCTCTCAGGGGTACAGCCAGAGGAT<br>GAGGCAGAATATTACTGTGTTCTATGGTACAGCAACCGCTGGGTGTTC<br>GGTGGAGGAACCAAACTGACTGTCCTA |
| 189. | 1-27 CD3ε-Fc | artificial | aa | QDGNEEMGGITQTPYKVSISGTTVILTSGEPKSCDKTHTCPPCPAPEL<br>LGGPSVFLFPPKPKDTLMISRTPEVTCVVVDVSHEDPEVKFNWYVDGV<br>EVHNAKTKPREEQYNSTYRVVSVLTVLHQDWLNGKEYKCKVSNKALPA<br>PIEKTISKAKGQPREPQVYTLPPSREEMTKNQVSLTCLVKGFYPSDIA<br>VEWESNGQPENNYKTTPPVLDSDGSFFLYSKLTVDKSRWQQGNVFSCS<br>VMHEALHNHYTQKSLSLSPGKHHHHHH |
| 190. | 1-27 CD3ε-Fc | artificial | nt | ATGGGATGGAGCTGTATCATCCTCTTCTTGGTAGCAACAGCTACAGGT<br>GTACACTCCCAAGATGGTAATGAAGAAATGGGTGGTATTACACAGACA<br>CCATATAAAGTCTCCATCTCTGGAACCACAGTAATATTGACATCCGGA<br>GAGCCCAAATCTTGTGACAAAACTCACACATGCCCACCGTGCCCAGCA<br>CCTGAACTCCTGGGGGGACCGTCAGTCTTCCTCTTCCCCCCAAAACCC<br>AAGGACACCCTCATGATCTCCCGGACCCCTGAGGTCACATGCGTGGTG<br>GTGGACGTGAGCCACGAAGACCCTGAGGTCAAGTTCAACTGGTACGTG<br>GACGGCGTGGAGGTGCATAATGCCAAGACAAAGCCGCGGGAGGAGCAG<br>TACAACAGCACGTACCGTGTGGTCAGCGTCCTCACCGTCCTGCACCAG<br>GACTGGCTGAATGGCAAGGAGTACAAGTGCAAGGTCTCCAACAAAGCC<br>CTCCCAGCCCCCATCGAGAAAACCATCTCCAAAGCCAAAGGGCAGCCC<br>CGAGAACCACAGGTGTACACCCTGCCCCCATCCCGGGAGGAGATGACC<br>AAGAACCAGGTCAGCCTGACCTGCCTGGTCAAAGGCTTCTATCCCAGC<br>GACATCGCCGTGGAGTGGGAGAGCAATGGGCAGCCGGAGAACAACTAC<br>AAGACCACGCCTCCCGTGCTGGACTCCGACGGCTCCTTCTTCCTCTAT<br>AGCAAGCTCACCGTGGACAAGAGCAGGTGGCAGCAGGGGAACGTCTTC<br>TCATGCTCCGTGATGCATGAGGCTCTGCACAACCACTACACGCAGAAG<br>AGCCTCTCCCTGTCCCGGGTAAACATCATCACCATCATCAT |
| 191. | human 1-27 CD3☐ε-EpCAM | artificial | aa | QDGNEEMGGITQTPYKVSISGTTVILTDYKDDDDKTASFAAAQKECVC<br>ENYKLAVNCFLNDNGQCQCTSIGAQNTVLCSKLAAKCLVMKAEMNGSK<br>LGRRAKPEGALQNNDGLYDPDCDESGLFKAKQCNGTSTCWCVNTAGVR<br>RTDKDTEITCSERVRTYWIIIELKHKAREKPYDVQSLRTALEEAIKTR<br>YQLDPKFITNILYEDNVITIDLVQNSSQKTQNDVDIADVAYYFEKDVK<br>GESLFHSKKMDLRVNGEQLDLDPGQTLIYYVDEKAPEFSMQGLKAGVI<br>AVIVVVVIAIVAGIVVLVISRKKRMAKYEKAEIKEMGEMHRELNA |
| 192. | human 1-27 CD3☐ε-EpCAM | artificial | nt | ATGGGATGGAGCTGTATCATCCTCTTCTTGGTAGCAACAGCTACAGGT<br>GTACACTCCCAAGATGGTAATGAAGAAATGGGTGGTATTACACAGACA<br>CCATATAAAGTCTCCATCTCTGGAACCACAGTAATATTGACAGATTAC<br>AAGGACGACGATGACAAGACTGCGAGTTTTGCCGCAGCTCAGAAAGAA<br>TGTGTCTGTGAAAACTACAAGCTGGCCGTAAACTGCTTTTTGAATGAC<br>AATGGTCAATGCCAGTGTACTTCGATTGGTGCACAAAATACTGTCCTT<br>TGCTCAAAGCTGGCTGCCAAATGTTTGGTGATGAAGGCAGAAATGAAC<br>GGCTCAAAACTTGGGAGAAGAGCGAAACCTGAAGGGGCTCTCCAGAAC<br>AATGATGGCCTTTACGATCCTGACTGCGATGAGAGCGGGCTCTTTAAG<br>GCCAAGCAGTGCAACGGCACCTCCACGTGCTGGTGTGTGAACACTGCT<br>GGGGTCAGAAGAACTGACAAGGACACTGAAATAACCTGCTCTGAGCGA<br>GTGAGAACCTACTGGATCATCATTGAATTAAAACACAAAGCAAGAGAA<br>AAACCTTATGATGTTCAAAGTTTGCGGACTGCACTTGAGGAGGCGATC<br>AAAACGCGTTATCAACTGGATCCAAAATTTATCACAAATATTTTGTAT<br>GAGGATAATGTTATCACTATTGATCTGGTTCAAAATTCTTCTCAGAAA<br>ACTCAGAATGATGTGGACATAGCTGATGTGGCTTATTATTTTGAAAAA<br>GATGTTAAAGGTGAATCCTTGTTTCATTCTAAGAAAATGGACCTGAGA<br>GTAAATGGGGAACAACTGGATCTGGATCCTGGTCAAACTTTAATTTAT<br>TATGTCGATGAAAAAGCACCTGAATTCTCAATGCAGGGTCTAAAAGCT<br>GGTGTTATTGCTGTTATTGTGGTTGTGGTGATAGCAATTGTTGCTGGA<br>ATTGTTGTGCTGGTTATTTCCAGAAAGAAGAGAATGGCAAAGTATGAG<br>AAGGCTGAGATAAAGGAGATGGGTGAGATGCATAGGGAACTCAATGCA |
| 193. | marmoset 1-27 CD3☐ε-EpCAM | artificial | aa | QDGNEEMGDTTQNPYKVSISGTTVTLTDYKDDDDKTASFAAAQKECVC<br>ENYKLAVNCFLNDNGQCQCTSIGAQNTVLCSKLAAKCLVMKAEMNGSK<br>LGRRAKPEGALQNNDGLYDPDCDESGLFKAKQCNGTSTCWCVNTAGVR<br>RTDKDTEITCSERVRTYWIIIELKHKAREKPYDVQSLRTALEEAIKTR<br>YQLDPKFITNILYEDNVITIDLVQNSSQKTQNDVDIADVAYYFEKDVK<br>GESLFHSKKMDLRVNGEQLDLDPGQTLIYYVDEKAPEFSMQGLKAGVI<br>AVIVVVVIAIVAGIVVLVISRKKRMAKYEKAEIKEMGEMHRELNA |
| 194. | marmoset 1-27 CD3☐ε-EpCAM | artificial | nt | ATGGGATGGAGCTGTATCATCCTCTTCTTGGTAGCAACAGCTACAGGT<br>GTACACTCCCAGGACGGTAATGAAGAAATGGGTGATACTACACAGAAC<br>CCATATAAAGTTTCCATCTCAGGAACCACAGTAACACTGACAGATTAC |

| SEQ ID NO. | DESIGNATION | SOURCE | TYPE | SEQUENCE |
|---|---|---|---|---|
| | | | | AAGGACGACGATGACAAGACTGCGAGTTTTGCCGCAGCTCAGAAAGAA<br>TGTGTCTGTGAAAACTACAAGCTGGCCGTAAACTGCTTTTTGAATGAC<br>AATGGTCAATGCCAGTGTACTTCGATTGGTGCACAAAATACTGTCCTT<br>TGCTCAAAGCTGGCTGCCAAATGTTTGGTGATGAAGGCAGAAATGAAC<br>GGCTCAAAACTTGGGAGAAGAGCGAAACCTGAAGGGGCTCTCCAGAAC<br>AATGATGGCCTTTACGATCCTGACTGCGATGAGAGCGGGCTCTTTAAG<br>GCCAAGCAGTGCAACGGCACCTCCACGTGCTGGTGTGTGAACACTGCT<br>GGGGTCAGAAGAACTGACAAGGACACTGAAATAACCTGCTCTGAGCGA<br>GTGAGAACCTACTGGATCATCATTGAATTAAAACACAAAGCAAGAGAA<br>AAACCTTATGATGTTCAAAGTTTGCGGACTGCACTTGAGGAGGCGATC<br>AAAACGCGTTATCAACTGGATCCAAAATTTATCACAAATATTTTGTAT<br>GAGGATAATGTTATCACTATTGATCTGGTTCAAAATTCTTCTCAGAAA<br>ACTCAGAATGATGTGGACATAGCTGATGTGGCTTATTATTTTGAAAAA<br>GATGTTAAAGGTGAATCCTTGTTTCATTCTAAGAAAATGGACCTGAGA<br>GTAAATGGGGAACAACTGGATCTGGATCCTGGTCAAACTTTAATTTAT<br>TATGTCGATGAAAAAGCACCTGAATTCTCAATGCAGGGTCTAAAAGCT<br>GGTGTTATTGCTGTTATTGTGGTTGTGGTGATAGCAATTGTTGCTGGA<br>ATTGTTGTGCTGGTTATTTCCAGAAAGAAGAGAATGGCAAAGTATGAG<br>AAGGCTGAGATAAAGGAGATGGGTGAGATGCATAGGGAACTCAATGCA |
| 195. | tamarin 1-27 CD3□ε-<br>EpCAM | artificial | aa | QDGNEEMGDTTQNPYKVSISGTTVTLTDYKDDDDKTASFAAAQKECVC<br>ENYKLAVNCFLNDNGQCQCTSIGAQNTVLCSKLAAKCLVMKAEMNGSK<br>LGRRAKPEGALQNNDGLYDPDCDESGLFKAKQCNGTSTCWCVNTAGVR<br>RTDKDTEITCSERVRTYWIIIELKHKAREKPYDVQSLRTALEEAIKTR<br>YQLDPKFITNILYEDNVITIDLVQNSSQKTQNDVDIADVAYYFEKDVK<br>GESLFHSKKMDLRVNGEQLDLDPGQTLIYYVDEKAPEFSMQGLKAGVI<br>AVIVVVVIAIVAGIVVLVISRKKRMAKYEKAEIKEMGEMHRELNA |
| 196. | tamarin 1-27 CD3□ε-<br>EpCAM | artificial | nt | ATGGGATGGAGCTGTATCATCCTCTTCTTGGTAGCAACAGCTACAGGT<br>GTACACTCCCAGGACGGTAATGAAGAAATGGGTGATACTACACAGAAC<br>CCATATAAAGTTTCCATCTCAGGAACCACAGTAACACTGACAGATTAC<br>AAGGACGACGATGACAAGACTGCGAGTTTTGCCGCAGCTCAGAAAGAA<br>TGTGTCTGTGAAAACTACAAGCTGGCCGTAAACTGCTTTTTGAATGAC<br>AATGGTCAATGCCAGTGTACTTCGATTGGTGCACAAAATACTGTCCTT<br>TGCTCAAAGCTGGCTGCCAAATGTTTGGTGATGAAGGCAGAAATGAAC<br>GGCTCAAAACTTGGGAGAAGAGCGAAACCTGAAGGGGCTCTCCAGAAC<br>AATGATGGCCTTTACGATCCTGACTGCGATGAGAGCGGGCTCTTTAAG<br>GCCAAGCAGTGCAACGGCACCTCCACGTGCTGGTGTGTGAACACTGCT<br>GGGGTCAGAAGAACTGACAAGGACACTGAAATAACCTGCTCTGAGCGA<br>GTGAGAACCTACTGGATCATCATTGAATTAAAACACAAAGCAAGAGAA<br>AAACCTTATGATGTTCAAAGTTTGCGGACTGCACTTGAGGAGGCGATC<br>AAAACGCGTTATCAACTGGATCCAAAATTTATCACAAATATTTTGTAT<br>GAGGATAATGTTATCACTATTGATCTGGTTCAAAATTCTTCTCAGAAA<br>ACTCAGAATGATGTGGACATAGCTGATGTGGCTTATTATTTTGAAAAA<br>GATGTTAAAGGTGAATCCTTGTTTCATTCTAAGAAAATGGACCTGAGA<br>GTAAATGGGGAACAACTGGATCTGGATCCTGGTCAAACTTTAATTTAT<br>TATGTCGATGAAAAAGCACCTGAATTCTCAATGCAGGGTCTAAAAGCT<br>GGTGTTATTGCTGTTATTGTGGTTGTGGTGATAGCAATTGTTGCTGGA<br>ATTGTTGTGCTGGTTATTTCCAGAAAGAAGAGAATGGCAAAGTATGAG<br>AAGGCTGAGATAAAGGAGATGGGTGAGATGCATAGGGAACTCAATGCA |
| 197. | squirrel monkey 1-27<br>CD3□ε-EpCAM | artificial | aa | QDGNEEIGDTTQNPYKVSISGTTVTLTDYKDDDDKTASFAAAQKECVC<br>ENYKLAVNCFLNDNGQCQCTSIGAQNTVLCSKLAAKCLVMKAEMNGSK<br>LGRRAKPEGALQNNDGLYDPDCDESGLFKAKQCNGTSTCWCVNTAGVR<br>RTDKDTEITCSERVRTYWIIIELKHKAREKPYDVQSLRTALEEAIKTR<br>YQLDPKFITNILYEDNVITIDLVQNSSQKTQNDVDIADVAYYFEKDVK<br>GESLFHSKKMDLRVNGEQLDLDPGQTLIYYVDEKAPEFSMQGLKAGVI<br>AVIVVVVIAIVAGIVVLVISRKKRMAKYEKAEIKEMGEMHRELNA |
| 198. | squirrel monkey 1-27<br>CD3□ε-EpCAM | artificial | nt | ATGGGATGGAGCTGTATCATCCTCTTCTTGGTAGCAACAGCTACAGGT<br>GTACACTCCCAGGACGGTAATGAAGAGATTGGTGATACTACCCAGAAC<br>CCATATAAAGTTTCCATCTCAGGAACCACAGTAACACTGACAGATTAC<br>AAGGACGACGATGACAAGACTGCGAGTTTTGCCGCAGCTCAGAAAGAA<br>TGTGTCTGTGAAAACTACAAGCTGGCCGTAAACTGCTTTTTGAATGAC<br>AATGGTCAATGCCAGTGTACTTCGATTGGTGCACAAAATACTGTCCTT<br>TGCTCAAAGCTGGCTGCCAAATGTTTGGTGATGAAGGCAGAAATGAAC<br>GGCTCAAAACTTGGGAGAAGAGCGAAACCTGAAGGGGCTCTCCAGAAC<br>AATGATGGCCTTTACGATCCTGACTGCGATGAGAGCGGGCTCTTTAAG<br>GCCAAGCAGTGCAACGGCACCTCCACGTGCTGGTGTGTGAACACTGCT<br>GGGGTCAGAAGAACTGACAAGGACACTGAAATAACCTGCTCTGAGCGA<br>GTGAGAACCTACTGGATCATCATTGAATTAAAACACAAAGCAAGAGAA<br>AAACCTTATGATGTTCAAAGTTTGCGGACTGCACTTGAGGAGGCGATC<br>AAAACGCGTTATCAACTGGATCCAAAATTTATCACAAATATTTTGTAT<br>GAGGATAATGTTATCACTATTGATCTGGTTCAAAATTCTTCTCAGAAA<br>ACTCAGAATGATGTGGACATAGCTGATGTGGCTTATTATTTTGAAAAA<br>GATGTTAAAGGTGAATCCTTGTTTCATTCTAAGAAAATGGACCTGAGA<br>GTAAATGGGGAACAACTGGATCTGGATCCTGGTCAAACTTTAATTTAT |

| SEQ ID NO. | DESIGNATION | SOURCE | TYPE | SEQUENCE |
|---|---|---|---|---|
| | | | | TATGTCGATGAAAAAGCACCTGAATTCTCAATGCAGGGTCTAAAAGCT GGTGTTATTGCTGTTATTGTGGTTGTGGTGATAGCAATTGTTGCTGGA ATTGTTGTGCTGGTTATTTCCAGAAAAGAAGAATGGCAAAGTATGAG AAGGCTGAGATAAAGGAGATGGGTGAGATGCATAGGGAACTCAATGCA |
| 199. | swine 1-27 CD3ε-EpCAM | artificial | aa | QEDIERPDEDTQKTFKVSISGDKVELTDYKDDDDKTASFAAAQKECVC ENYKLAVNCFLNDNGQCQCTSIGAQNTVLCSKLAAKCLVMKAEMNGSK LGRRAKPEGALQNNDGLYDPDCDESGLFKAKQCNGTSTCWCVNTAGVR RTDKDTEITCSERVRTYWIIIELKHKAREKPYDVQSLRTALEEAIKTR YQLDPKFITNILYEDNVITIDLVQNSSQKTQNDVDIADVAYYFEKDVK GESLFHSKKMDLRVNGEQLDLDPGQTLIYYVDEKAPEFSMQGLKAGVI AVIVVVVIAIVAGIVVLVISRKKRMAKYEKAEIKEMGEMHRELNA |
| 200. | swine 1-27 CD3ε-EpCAM | artificial | nt | ATGGGATGGAGCTGTATCATCCTCTTCTTGGTAGCAACAGCTACAGGT GTACACTCCCAAGAAGACATTGAAAGACCCAGATGAAGATACACAGAAA ACATTTAAAGTCTCCATCTCTGGAGACAAAGTAGAGCTGACAGATTAC AAGGACGACGATGACAAGACTGCGAGTTTTGCCGCAGCTCAGAAAGAA TGTGTCTGTGAAAACTACAAGCTGGCCGTAAACTGCTTTTTGAATGAC AATGGTCAATGCCAGTGTACTTCGATTGGTGCACAAAATACTGTCCTT TGCTCAAAGCTGGCTGCCAAATGTTTGGTGATGAAGGCAGAAATGAAC GGCTCAAAACTTGGGAGAAGAGCGAAACCTGAAGGGGCTCTCCAGAAC AATGATGGCCTTTACGATCCTGACTGCGATGAGAGCGGGCTCTTTAAG GCCAAGCAGTGCAACGGCACCTCCACGTGCTGGTGTGTGAACACTGCT GGGGTCAGAAGAACTGACAAGGACACTGAAATAACCTGCTCTGAGCGA GTGAGAACCTACTGGATCATCATTGAATTAAAACACAAAGCAAGAGAA AAACCTTATGATGTTCAAAGTTTGCGGACTGCACTTGAGGAGGCGATC AAAACGCGTTATCAACTGGATCCAAAATTTATCACAAATATTTTGTAT GAGGATAATGTTATCACTATTGATCTGGTTCAAAATTCTTCTCAGAAA ACTCAGAATGATGTGGACATAGCTGATGTGGCTTATTATTTTGAAAAA GATGTTAAAGGTGAATCCTTGTTTCATTCTAAGAAAATGGACCTGAGA GTAAATGGGGAACAACTGGATCTGGATCCTGGTCAAACTTTAATTTAT TATGTCGATGAAAAAGCACCTGAATTCTCAATGCAGGGTCTAAAAGCT GGTGTTATTGCTGTTATTGTGGTTGTGGTGATAGCAATTGTTGCTGGA ATTGTTGTGCTGGTTATTTCCAGAAAAGAAGAATGGCAAAGTATGAG AAGGCTGAGATAAAGGAGATGGGTGAGATGCATAGGGAACTCAATGCA |
| 201. | human CD3 epsilon chain | human | aa | QDGNEEMGGITQTPYKVSISGTTVILTCPQYPGSEILWQHNDKNIGGD EDDKNIGSDEDHLSLKEFSELEQSGYYVCYPRGSKPEDANFYLYLRAR VCENCMEMDVMSVATIVIVDICITGGLLLLVYYWSKNRKAKAKPVTRG AGAGGRQRGQNKERPPPVPNPDYEPIRKGQRDLYSGLNQRRI |
| 202. | human CD3 epsilon chain | human | nt | ATGCAGTCGGGCACTCACTGGAGAGTTCTGGGCCTCTGCCTCTTATCA GTTGGCGTTTGGGGGCAAGATGGTAATGAAGAAATGGGTGGTATTACA CAGACACCATATAAAGTCTCCATCTCTGGAACCACAGTAATATTGACA TGCCCTCAGTATCCTGGATCTGAAATACTATGGCAACACAATGATAAA AACATAGGCGGTGATGAGGATGATAAAAACATAGGCAGTGATGAGGAT CACCTGTCACTGAAGGAATTTTCAGAATTGGAGCAAAGTGGTTATTAT GTCTGCTACCCCAGAGGAAGCAAACCAGAAGATGCGAACTTTTATCTC TACCTGAGGGCACGCGTGTGTGAGAACTGCATGGAGATGGATGTGATG TCGGTGGCCACAATTGTCATAGTGGACATCTGCATCACTGGGGGCTTG CTGCTGCTGGTTTACTACTGGAGCAAGAATAGAAAGGCCAAGGCCAAG CCTGTGACACGAGGAGCGGGTGCTGGCGGCAGGCAAAGGGGACAAAAC AAGGAGAGGCCACCACCTGTTCCCAACCCAGACTATGAGCCCATCCGG AAAGGCCAGCGGGACCTGTATTCTGGCCTGAATCAGAGGACGCATC |
| 203. | 19 amino acid immuno-globulin leader peptide | artificial | aa | MGWSCIILFLVATATGVHS |
| 204. | 19 amino acid immuno-globulin leader peptide | artificial | nt | ATGGGATGGAGCTGTATCATCCTCTTCTTGGTAGCAACAGCTACAGGT GTACACTCC |
| 205. | murine IgG1 heavy chain constant region | murine | aa | AKTTPPSVYPLAPGSAAQTNSMVTLGCLVKGYFPEPVTVTWNSGSLSS GVHTFPAVLQSDLYTLSSSVTVPSSTWPSETVTCNVAHPASSTKVDKK IVPRDCGCKPCICTVPEVSSVFIFPPKPKDVLTITLTPKVTCVVVDIS KDDPEVQFSWFVDDVEVHTAQTQPREEQFNSTFRSVSELPIMHQDWLN GKEFKCRVNSAAFPAPIEKTISKTKGRPKAPQVYTIPPPKEQMAKDKV SLTCMITDFFPEDITVEWQWNGQPAENYKNTQPIMDTDGSYFVYSKLN VQKSNWEAGNTFTCSVLHEGLHNHHTEKSLSHSPGK |
| 206. | murine IgG1 heavy chain constant region | murine | nt | GCCAAAACGACACCCCCATCTGTCTATCCACTGGCCCCTGGATCTGCT GCCCAAACTAACTCCATGGTGACCCTGGGATGCCTGGTCAAGGGCTAT TTCCCTGAGCCAGTGACAGTGACCTGGAACTCTGGATCCCTGTCCAGC GGTGTGCACACCTTCCCAGCTGTCCTGCAGTCTGACCTCTACACTCTG AGCAGCTCAGTGACTGTCCCCTCCAGCACCTGGCCCAGCGAGACCGTC ACCTGCAACGTTGCCCACCCGGCCAGCAGCACCAAGGTGGACAAGAAA ATTGTGCCCAGGGATTGTGGTTGTAAGCCTTGCATATGTACAGTCCCA GAAGTATCATCTGTCTTCATCTTCCCCCCAAAGCCCAAGGATGTGCTC |

| SEQ ID NO. | DESIGNATION | SOURCE | TYPE | SEQUENCE |
|---|---|---|---|---|
| | | | | ACCATTACTCTGACTCCTAAGGTCACGTGTGTTGTGGTAGACATCAGC AAGGATGATCCCGAGGTCCAGTTCAGCTGGTTTGTAGATGATGTGGAG GTGCACACAGCTCAGACGCAACCCCGGGAGGAGCAGTTCAACAGCACT TTCCGCTCAGTCAGTGAACTTCCCATCATGCACCAGGACTGGCTCAAT GGCAAGGAGTTCAAATGCAGGGTCAACAGTGCAGCTTTCCCTGCCCCC ATCGAGAAAACCATCTCCAAAACCAAAGGCAGACCGAAGGCTCCACAG GTGTACACCATTCCACCTCCCAAGGAGCAGATGGCCAAGGATAAAGTC AGTCTGACCTGCATGATAACAGACTTCTTCCCTGAAGACATTACTGTG GAGTGGCAGTGGAATGGGCAGCCAGCGGAGAACTACAAGAACACTCAG CCCATCATGGACACAGATGGCTCTTACTTCGTCTACAGCAAGCTCAAT GTGCAGAAGAGCAACTGGGAGGCAGGAAATACTTTCACCTGCTCTGTG TTACATGAGGGCCTGCACAACCACCATACTGAGAAGAGCCTCTCCCAC TCTCCTGGTAAA |
| 207. | human lambda light chain constant region | human | aa | GQPKAAPSVTLFPPSSEELQANKATLVCLISDFYPGAVTVAWKADSSP VKAGVETTTPSKQSNNKYAASSYLSLTPEQWKSHKSYSCQVTHEGSTV EKTVAPTECS |
| 208. | human lambda light chain constant region | human | nt | GGTCAGCCCAAGGCTGCCCCCTCGGTCACTCTGTTCCCACCCTCCTCT GAGGAGCTTCAAGCCAACAAGGCCACACTGGTGTGTCTCATAAGTGAC TTCTACCCGGGAGCCGTGACAGTGGCCTGGAAGGCAGATAGCAGCCCC GTCAAGGCGGGAGTGGAGACCACCACACCCTCCAAACAAAGCAACAAC AAGTACGCGGCCAGCAGCTACCTGAGCCTGACGCCTGAGCAGTGGAAG TCCCACAAAAGCTACAGCTGCCAGGTCACGCATGAAGGGAGCACCGTG GAGAAGACAGTGGCCCCTACAGAATGTTCA |
| 209. | 1-27 CD3-Fc + Leader | artificial | nt | ATGGGATGGAGCTGTATCATCCTCTTCTTGGTAGCAACAGCTACAGGT GTACACTCCCAAGATGGTAATGAAGAAATGGGTGGTATTACACAGACA CCTATATAAGTCTCCATCTCTGGAACCACAGTAATATTGACATCCGGA GAGCCCAAATCTTGTGACAAAACTCACACATGCCCACCGTGCCCAGCA CCTGAACTCCTGGGGGGACCGTCAGTCTTCCTCTTCCCCCCAAAACCC AAGGACACCCTCATGATCTCCCGGACCCCTGAGGTCACATGCGTGGTG GTGGACGTGAGCCACGAAGACCCTGAGGTCAAGTTCAACTGGTACGTG GACGGCGTGGAGGTGCATAATGCCAAGACAAAGCCGCGGGAGGAGCAG TACAACAGCACGTACCGTGTGGTCAGCGTCCTCACCGTCCTGCACCAG GACTGGCTGAATGGCAAGGAGTACAAGTGCAAGGTCTCCAACAAAGCC CTCCCAGCCCCCATCGAGAAAACCATCTCCAAAGCCAAAGGGCAGCCC CGAGAACCACAGGTGTACACCCTGCCCCCATCCCGGGAGGAGATGACC AAGAACCAGGTCAGCCTGACCTGCCTGGTCAAAGGCTTCTATCCCAGC GACATCGCCGTGGAGTGGGAGAGCAATGGGCAGCCGGAGAACAACTAC AAGACCACGCCTCCCGTGCTGGACTCCGACGGCTCCTTCTTCCTCTAT AGCAAGCTCACCGTGGACAAGAGCAGGTGGCAGCAGGGGAACGTCTTC TCATGCTCCGTGATGCATGAGGCTCTGCACAACCACTACACGCAGAAG AGCCTCTCCCTGTCCCCGGGTAAATAG |
| 210. | 1-27 CD3-Fc + Leader | artificial | aa | MGWSCIILFLVATATGVHSQDGNEEMGGITQTPYKVSISGTTVILTSG EPKSCDKTHTCPPCPAPELLGGPSVFLFPPKPKDTLMISRTPEVTCVV VDVSHEDPEVKFNWYVDGVEVHNAKTKPREEQYNSTYRVVSVLTVLHQ DWLNGKEYKCKVSNKALPAPIEKTISKAKGQPREPQVYTLPPSREEMT KNQVSLTCLVKGFYPSDIAVEWESNGQPENNYKTTPPVLDSDGSFFLY SKLTVDKSRWQQGNVFSCSVMHEALHNHYTQKSLSLSPGK |
| 211. | Human CD3ε 1-8 (N-terminus) | human | aa | QDGNEEMG |
| 212. | Saimiri sciureus CD3ε 1-8 (N-terminus) | Saimiri sciureus | aa | QDGNEEIG |
| 213. | forward primer | artificial | nt | CACTGTGGCCCAGGTTCGAGG |
| 214. | reverse primer | artificial | nt | GACATACCACACAAATTCAATACGG |
| 215. | forward primer | artificial | nt | GCTCTGCTCGCGCCGAGATGTGG |
| 216. | reverse primer | artificial | nt | ACGCTGGACACCACCTCCAGG |
| 217. | forward primer | artificial | nt | GGTTCTACTGAGTGGGCAGAGG |
| 218. | reverse primer | artificial | nt | ACTTGTTGTGGCTGCTTGGAGC |
| 219. | forward primer | artificial | nt | GGGTGAAGTCCTATCCAGATGG |
| 220. | reverse primer | artificial | nt | GTGCTCTGCCTGAAGCAATTCC |
| 221. | forward primer | artificial | nt | CTCGGCTTCCTCTTCGGGTGG |
| 222. | reverse primer | artificial | nt | GCATATTCATTTGCTGGGTAACCTGG |

| SEQ ID NO. | DESIGNATION | SOURCE | TYPE | SEQUENCE |
|---|---|---|---|---|
| 223. | macaque PSMA (Cynomolgus) | artificial | nt | ATGTGGAATCTCCTGCACGAAACCGACTCGGCTGTGGCCACCGCGCGC<br>CGCCCGCGCTGGCTGTGCGCTGGGGCACTGGTGCTGGCGGGTGGCTTC<br>TTTCTCCTCGGCTTCCTCTTCGGATGGTTTATAAAATCCTCCAGTGAA<br>GCTACTAACATTACTCCAAAGCATAATATGAAAGCATTTTTGGATGAA<br>CTGAAAGCTGAGAACATCAAGAAGTTCTTACATAATTTTACACAGATA<br>CCACATTTAGCAGGAACAGAACAAAACTTTCAACTTGCAAAGCAAATT<br>CAATCCCAGTGGAAAGAATTTGGCCTGGATTCTGTTGAGCTAACTCAT<br>TATGATGTCCTGTTGTCCTACCCAAATAAGACTCATCCCAACTACATC<br>TCAATAATTAATGAAGATGGAAATGAGATTTTCAACACATCATTATTT<br>GAACCACCTCCTGCAGGATATGAAAATGTTTCGGATATTGTACCACCT<br>TTCAGTGCTTTCTCTCCTCAAGGAATGCCAGAGGGCGATCTAGTGTAT<br>GTTAACTATGCACGAACTGAAGACTTCTTTAAATTGGAACGGGACATG<br>AAAATCAATTGCTCTGGGAAAATTGTAATTGCCAGATATGGGAAAGTT<br>TTCAGAGGGAAATAAGGTTAAAAATGCCCAGCTGGCAGGGGCCACAGGA<br>GTCATTCTCTACTCAGACCCTGCTGACTACTTTGCTCCTGGGGTAAAG<br>TCTTATCCAGATGGTTGGAATCTTCCTGGAGGTGGTGTCCAGCGTGGA<br>AATATCCTAAATCTGAATGGTGCAGGAGACCCTCTCACACCAGGTTAC<br>CCAGCAAATGAATATGCTTATAGGCGTGGAATGGCAGAGGCTGTTGGT<br>CTTCCAAGTATTCCCGTTCATCCAATTGGGTACTATGATGCACAGAAG<br>CTCCTAGAAAAAATGGGTGGCTCAGCATCACCAGATAGCAGCTGGAGA<br>GGAAGTCTCAAAGTGCCCTACAATGTTGGACCTGGCTTTACTGGAAAC<br>TTTTCTACACAAAAAGTCAAGATGCACATCCACTCTACCAGTGAAGTG<br>ACAAGAATTTACAATGTGATAGGTACTCTCAGAGGAGCAGTGGAACCA<br>GACAGATACGTCATTCTGGGAGGTCACCGGGACTCATGGGTGTTTGGT<br>GGTATTGACCCTCAGAGTGGAGCAGCTGTTGTTCATGAAATTGTGAGG<br>AGCTTTGGAACGCTGAAAAAGGAAGGGTGGAGACCTAGAAGAACAATT<br>TTGTTTGCAAGCTGGGATGCAGAAGAATTTGGTCTTCTTGGTTCTACT<br>GAATGGGCAGAGGAGAATTCAAGACTCCTTCAAGAGCGTGGCGTGGCT<br>TATATTAATGCTGATTCGTCTATAGAGGGAAACTACACTCTGAGAGTT<br>GATTGTACACCACTGATGTACAGCTTGGTATACAACCTAACAAAAGAG<br>CTGGAAAGCCCTGATGAAGGCTTTGAAGGCAAATCTCTTTATGAAAGT<br>TGGACTAAAAAAAGTCCTTCCCCCGAGTTCAGTGGCATGCCCAGGATA<br>AGCAAATTGGGATCTGGAAATGATTTTGAGGTGTTCTTCCAACGACTT<br>GGAATTGCCTCAGGCAGAGCACGGTATACTAAAAATTGGGAAACAAAC<br>AAATTCAGCAGCTATCCACTGTATCACAGTGTCTATGAGACATATGAG<br>TTGGTGGAAAAGTTTTATGATCCAATGTTTAAATATCACCTCACTGTG<br>GCCCAGGTTCGAGGAGGGATGGTGTTTGAACTAGCCAATTCCGTAGTG<br>CTCCCTTTTGATTGTCGAGATTATGCTGTAGTTTTAAGAAAGTATGCT<br>GACAAAATCTACAATATTTCTATGAAACATCCACAGGAAATGAAGACA<br>TACAGTGTATCATTTGATTCACTTTTTTCTGCAGTAAAGAATTTTACA<br>GAAATTGCTTCCAAGTTCAGCGAGAGACTCCGGGACTTTGACAAAAGC<br>AACCCAATATTATTAAGAATGATGAATGATCAACTCATGTTTCTGGAA<br>AGAGCATTTATTGATCCATTAGGGTTACCAGACAGACCTTTTTATAGG<br>CATGTCATCTATGCTCCAAGCAGCCACAACAAGTATGCAGGGGAGTCA<br>TTCCCAGGAATTTATGATGCTCTGTTTGATATCGAAAGCAAAGTGGAC<br>CCTTCCCAGGCCTGGGGAGAAGTGAAGAGACAGATTTCTGTTGCAACC<br>TTCACAGTGCAAGCAGCTGCAGAGACTTTGAGTGAAGTGGCCTAA |
| 224. | macaque PSMA (Cynomolgus) | artificial | aa | MWNLLHETDSAVATARRPRWLCAGALVLAGGFFLLGFLFGWFIKSSSE<br>ATNITPKHNMKAFLDELKAENIKKFLHNFTQIPHLAGTEQNFQLAKQI<br>QSQWKEFGLDSVELTHYDVLLSYPNKTHPNYISIINEDGNEIFNTSLF<br>EPPPAGYENVSDIVPPFSAFSPQGMPEGDLVYVNYARTEDFFKLERDM<br>KINCSGKIVIARYGKVFRGNKVKNAQLAGATGVILYSDPADYFAPGVK<br>SYPDGWNLPGGGVQRGNILNLNGAGDPLTPGYPANEYAYRRGMAEAVG<br>LPSIPVHPIGYYDAQKLLEKMGGSASPDSSWRGSLKVPYNVGPGFTGN<br>FSTQKVKMHIHSTSEVTRIYNVIGTLRGAVEPDRYVILGGHRDSWVFG<br>GIDPQSGAAVVHEIVRSFGTLKKEGWRPRRTILFASWDAEEFGLLGST<br>EWAEENSRLLQERGVAYINADSSIEGNYTLRVDCTPLMYSLVYNLTKE<br>LESPDEGFEGKSLYESWTKKSPSPEFSGMPRISKLGSGNDFEVFFQRL<br>GIASGRARYTKNWETNKFSSYPLYHSVYETYELVEKFYDPMFKYHLTV<br>AQVRGGMVFELANSVVLPFDCRDYAVVLRKYADKIYNISMKHPQEMKT<br>YSVSFDSLFSAVKNFTEIASKFSERLRDFDKSNPILLRMMNDQLMFLE<br>RAFIDPLGLPDRPFYRHVIYAPSSHNKYAGESFPGIYDALFDIESKVD<br>PSQAWGEVKRQISVATFTVQAAAETLSEVA |
| 225. | PM52C3-VH | artificial | aa | QVQLVQSGAEVKKPGASVKLSCKASGYTFTYFDINWVRQTPEQGLEWM<br>GGISPGDGNTNYNENFKGRVTMTRDTSSSTAYMELSRLRSDDTAVYYC<br>ARDGNFPYYAMDSWGQGTTVTVSS |
| 226. | PM52C3-HCDR1 | artificial | aa | YFDIN |
| 227. | PM52C3-HCDR2 | artificial | aa | GISPGDGNTNYNENFKG |
| 228. | PM52C3-HCDR3 | artificial | aa | DGNFPYYAMDS |

-continued

| SEQ ID NO. | DESIGNATION | SOURCE | TYPE | SEQUENCE |
|---|---|---|---|---|
| 229. | PM52C3-VH | artificial | nt | CAGGTGCAGCTGGTCCAGTCTGGCGCCGAAGTGAAGAAGCCTGGCGCC<br>TCCGTGAAGCTGTCCTGCAAGGCCTCCGGCTACACCTTCACCTACTTC<br>GACATCAACTGGGTGCGGCAGACGCCTGAGCAGGGCCTGGAATGGATG<br>GGCGGCATCTCCCCTGGCGACGGCAACACCAACTACAACGAGAACTTC<br>AAGGGCAGGGTCACAATGACCAGAGACACGTCCTCATCCACCGCCTAC<br>ATGGAGCTGTCCCGGCTGAGATCTGACGACACCGCCGTGTACTACTGC<br>GCCAGGGACGGCAACTTCCCTTACTACGCCATGGACTCTTGGGGCCAG<br>GGCACCACGGTCACCGTCTCCTCA |
| 230. | PM52C3-VL | artificial | aa | DVVMTQSPLSLPVTLGEPASISCRSSQSLVYSNGNTYLHWYQQKPGQS<br>PRLLIYKVSNRFSGVPDRFSGSGSGTDFTLKISRVEAEDVGVYFCSQS<br>THVPYTFGQGTKLEIK |
| 231. | PM52C3-LCDR1 | artificial | aa | RSSQSLVYSNGNTYLH |
| 232. | PM52C3-LCDR2 | artificial | aa | KVSNRFS |
| 233. | PM52C3-LCDR3 | artificial | aa | SQSTHVPYT |
| 234. | PM52C3-VL | artificial | nt | GACGTCGTGATGACTCAGTCTCCACTCTCCCTGCCCGTCACCCTTGGA<br>GAGCCGGCCTCCATCTCCTGCAGGTCTAGTCAAAGCCTCGTATACAGT<br>AACGGAAACACCTACTTGCATTGGTATCAACAGAAGCCAGGCCAATCT<br>CCAAGACTCCTAATTTATAAGGTTTCTAACCGGTTCTCTGGGGTCCCA<br>GACAGATTCAGCGGCAGTGGGTCAGGCACTGATTTCACACTGAAAATC<br>AGCAGGGTGGAGGCTGAGGATGTTGGGGTTTATTTCTGCTCTCAAAGT<br>ACACATGTTCCGTACACGTTTGGCCAGGGGACCAAGCTGGAGATCAAA |
| 235. | PM52C3-VH-VL | artificial | aa | QVQLVQSGAEVKKPGASVKLSCKASGYTFTYFDINWVRQTPEQGLEWM<br>GGISPGDGNTNYNENFKGRVTMTRDTSSSTAYMELSRLRSDDTAVYYC<br>ARDGNFPYYAMDSWGQGTTVTVSSGGGGSGGGGSGGGGSDVVMTQSPL<br>SLPVTLGEPASISCRSSQSLVYSNGNTYLHWYQQKPGQSPRLLIYKVS<br>NRFSGVPDRFSGSGSGTDFTLKISRVEAEDVGVYFCSQSTHVPYTFGQ<br>GTKLEIK |
| 236. | PM52C3-VH-VL | artificial | nt | CAGGTGCAGCTGGTCCAGTCTGGCGCCGAAGTGAAGAAGCCTGGCGCC<br>TCCGTGAAGCTGTCCTGCAAGGCCTCCGGCTACACCTTCACCTACTTC<br>GACATCAACTGGGTGCGGCAGACGCCTGAGCAGGGCCTGGAATGGATG<br>GGCGGCATCTCCCCTGGCGACGGCAACACCAACTACAACGAGAACTTC<br>AAGGGCAGGGTCACAATGACCAGAGACACGTCCTCATCCACCGCCTAC<br>ATGGAGCTGTCCCGGCTGAGATCTGACGACACCGCCGTGTACTACTGC<br>GCCAGGGACGGCAACTTCCCTTACTACGCCATGGACTCTTGGGGCCAG<br>GGCACCACGGTCACCGTCTCCTCAGGTGGTGGTGGTTCTGGCGGCGGC<br>GGCTCCGGTGGTGGTGGTTCTGACGTCGTGATGACTCAGTCTCCACTC<br>TCCCTGCCCGTCACCCTTGGAGAGCCGGCCTCCATCTCCTGCAGGTCT<br>AGTCAAAGCCTCGTATACAGTAACGGAAACACCTACTTGCATTGGTAT<br>CAACAGAAGCCAGGCCAATCTCCAAGACTCCTAATTTATAAGGTTTCT<br>AACCGGTTCTCTGGGGTCCCAGACAGATTCAGCGGCAGTGGGTCAGGC<br>ACTGATTTCACACTGAAAATCAGCAGGGTGGAGGCTGAGGATGTTGGG<br>GTTTATTTCTGCTCTCAAAGTACACATGTTCCGTACACGTTTGGCCAG<br>GGGACCAAGCTGGAGATCAAA |
| 237. | PM52C3 VH-VL × I2C VH-VL | artificial | aa | QVQLVQSGAEVKKPGASVKLSCKASGYTFTYFDINWVRQTPEQGLEWM<br>GGISPGDGNTNYNENFKGRVTMTRDTSSSTAYMELSRLRSDDTAVYYC<br>ARDGNFPYYAMDSWGQGTTVTVSSGGGGSGGGGSGGGGSDVVMTQSPL<br>SLPVTLGEPASISCRSSQSLVYSNGNTYLHWYQQKPGQSPRLLIYKVS<br>NRFSGVPDRFSGSGSGTDFTLKISRVEAEDVGVYFCSQSTHVPYTFGQ<br>GTKLEIKSGGGGSEVQLVESGGGLVQPGGSLKLSCAASGFTFNKYAMN<br>WVRQAPGKGLEWVARIRSKYNNYATYYADSVKDRFTISRDDSKNTAYL<br>QMNNLKTEDTAVYYCVRHGNFGNSYISYWAYWGQGTLVTVSSGGGGSG<br>GGGSGGGGSQTVVTQEPSLTVSPGGTVTLTCGSSTGAVTSGNYPNWVQ<br>QKPGQAPRGLIGGTKFLAPGTPARFSGSLLGGKAALTLSGVQPEDEAE<br>YYCVLWYSNRWVFGGGTKLTVL |
| 238. | PM52C3 VH-VL × I2C VH-VL | artificial | nt | CAGGTGCAGCTGGTCCAGTCTGGCGCCGAAGTGAAGAAGCCTGGCGCC<br>TCCGTGAAGCTGTCCTGCAAGGCCTCCGGCTACACCTTCACCTACTTC<br>GACATCAACTGGGTGCGGCAGACGCCTGAGCAGGGCCTGGAATGGATG<br>GGCGGCATCTCCCCTGGCGACGGCAACACCAACTACAACGAGAACTTC<br>AAGGGCAGGGTCACAATGACCAGAGACACGTCCTCATCCACCGCCTAC<br>ATGGAGCTGTCCCGGCTGAGATCTGACGACACCGCCGTGTACTACTGC<br>GCCAGGGACGGCAACTTCCCTTACTACGCCATGGACTCTTGGGGCCAG<br>GGCACCACGGTCACCGTCTCCTCAGGTGGTGGTGGTTCTGGCGGCGGC<br>GGCTCCGGTGGTGGTGGTTCTGACGTCGTGATGACTCAGTCTCCACTC<br>TCCCTGCCCGTCACCCTTGGAGAGCCGGCCTCCATCTCCTGCAGGTCT<br>AGTCAAAGCCTCGTATACAGTAACGGAAACACCTACTTGCATTGGTAT<br>CAACAGAAGCCAGGCCAATCTCCAAGACTCCTAATTTATAAGGTTTCT<br>AACCGGTTCTCTGGGGTCCCAGACAGATTCAGCGGCAGTGGGTCAGGC |

| SEQ ID NO. | DESIGNATION | SOURCE | TYPE | SEQUENCE |
|---|---|---|---|---|
| | | | | ACTGATTTCACACTGAAAATCAGCAGGGTGGAGGCTGAGGATGTTGGG<br>GTTTATTTCTGCTCTCAAAGTACACATGTTCCGTACACGTTTGGCCAG<br>GGGACCAAGCTGGAGATCAAATCCGGAGGTGGTGGATCCGAGGTGCAG<br>CTGGTCGAGTCTGGAGGAGGATTGGTGCAGCCTGGAGGGTCATTGAAA<br>CTCTCATGTGCAGCCTCTGGATTCACCTTCAATAAGTACGCCATGAAC<br>TGGGTCCGCCAGGCTCCAGGAAAGGGTTTGGAATGGGTTGCTCGCATA<br>AGAAGTAAATATAATAATTATGCAACATATTATGCCGATTCAGTGAAA<br>GACAGGTTCACCATCTCCAGAGATGATTCAAAAAACACTGCCTATCTA<br>CAAATGAACAACTTGAAAACTGAGGACACTGCCGTGTACTACTGTGTG<br>AGACATGGGAACTTCGGTAATAGCTACATATCCTACTGGGCTTACTGG<br>GGCCAAGGGACTCTGGTCACCGTCTCCTCAGGTGGTGGTGGTTCTGGC<br>GGCGGCGGCTCCGGTGGTGGTGGTTCTCAGACTGTTGTGACTCAGGAA<br>CCTTCACTCACCGTATCACCTGGTGGAACAGTCACACTCACTTGTGGC<br>TCCTCGACTGGGGCTGTTACATCTGGCAACTACCCAAACTGGGTCCAA<br>CAAAAACCAGGTCAGGCACCCCGTGGTCTAATAGGTGGGACTAAGTTC<br>CTCGCCCCCGGTACTCCTGCCAGATTCTCAGGCTCCCTGCTTGGAGGC<br>AAGGCTGCCCTCACCCTCTCAGGGGTACAGCCAGAGGATGAGGCAGAA<br>TATTACTGTGTTCTATGGTACAGCAACCGCTGGGTGTTCGGTGGAGGA<br>ACCAAACTGACTGTCCTA |
| 239. | PM52H3-VH | artificial | aa | QVQLVQSGAEVKKPGASVKLSCKASGYTFTYFDINWVRQTPEQGLEWM<br>GGISPGDGNTNYNENFKGRVTMTRDTSKSTAYMELSRLRSDDTAVYYC<br>ARDGNFPYYAMDSWGQGTTVTVSS |
| 240. | PM52H3-HCDR1 | artificial | aa | YFDIN |
| 241. | PM52H3-HCDR2 | artificial | aa | GISPGDGNTNYNENFKG |
| 242. | PM52H3-HCDR3 | artificial | aa | DGNFPYYAMDS |
| 243. | PM52H3-VH | artificial | nt | CAGGTGCAGCTGGTCCAGTCTGGCGCCGAAGTGAAGAAGCCTGGCGCC<br>TCCGTGAAGCTGTCCTGCAAGGCCTCCGGCTACACCTTCACCTACTTC<br>GACATCAACTGGGTGCGGCAGACGCCTGAGCAGGGCCTGGAATGGATG<br>GGCGGCATCTCCCCTGGCGACGGCAACACCAACTACAACGAGAACTTC<br>AAGGGCAGGGTCACAATGACCAGAGACACGTCCAAATCCACCGCCTAC<br>ATGGAGCTGTCCCGGCTGAGATCTGACGACACCGCCGTGTACTACTGC<br>GCCAGGGACGGCAACTTCCCTTACTACGCCATGGACTCTTGGGGCCAG<br>GGCACCACGGTCACCGTCTCCTCA |
| 244. | PM52H3-VL | artificial | aa | DVVMTQSPLSLPVTLGEPASISCRSSQSLVYSNGNTYLHWYQQKPGQS<br>PRLLIYKVSNRFSGVPDRFSGSGSGTDFTLKISRVEAEDVGVYFCSQS<br>THVPYTFGQGTKLEIK |
| 245. | PM52H3-LCDR1 | artificial | aa | RSSQSLVYSNGNTYLH |
| 246. | PM52H3-LCDR2 | artificial | aa | KVSNRFS |
| 247. | PM52H3-LCDR3 | artificial | aa | SQSTHVPYT |
| 248. | PM52H3-VL | artificial | nt | GACGTCGTGATGACTCAGTCTCCACTCTCCCTGCCCGTCACCCTTGGA<br>GAGCCGGCCTCCATCTCCTGCAGGTCTAGTCAAAGCCTCGTATACAGT<br>AACGGAAACACCTACTTGCATTGGTATCAACAGAAGCCAGGCCAATCT<br>CCAAGACTCCTAATTTATAAGGTTTCTAACCGGTTCTCTGGGGTCCCA<br>GACAGATTCAGCGGCAGTGGGTCAGGCACTGATTTCACACTGAAAATC<br>AGCAGGGTGGAGGCTGAGGATGTTGGGGTTTATTTCTGCTCTCAAAGT<br>ACACATGTTCCGTACACGTTTGGCCAGGGGACCAAGCTGGAGATCAAA |
| 249. | PM52H3-VH-VL | artificial | aa | QVQLVQSGAEVKKPGASVKLSCKASGYTFTYFDINWVRQTPEQGLEWM<br>GGISPGDGNTNYNENFKGRVTMTRDTSKSTAYMELSRLRSDDTAVYYC<br>ARDGNFPYYAMDSWGQGTTVTVSSGGGGSGGGGSGGGGSDVVMTQSPL<br>SLPVTLGEPASISCRSSQSLVYSNGNTYLHWYQQKPGQSPRLLIYKVS<br>NRFSGVPDRFSGSGSGTDFTLKISRVEAEDVGVYFCSQSTHVPYTFGQ<br>GTKLEIK |
| 250. | PM52H3-VH-VL | artificial | nt | CAGGTGCAGCTGGTCCAGTCTGGCGCCGAAGTGAAGAAGCCTGGCGCC<br>TCCGTGAAGCTGTCCTGCAAGGCCTCCGGCTACACCTTCACCTACTTC<br>GACATCAACTGGGTGCGGCAGACGCCTGAGCAGGGCCTGGAATGGATG<br>GGCGGCATCTCCCCTGGCGACGGCAACACCAACTACAACGAGAACTTC<br>AAGGGCAGGGTCACAATGACCAGAGACACGTCCAAATCCACCGCCTAC<br>ATGGAGCTGTCCCGGCTGAGATCTGACGACACCGCCGTGTACTACTGC<br>GCCAGGGACGGCAACTTCCCTTACTACGCCATGGACTCTTGGGGCCAG<br>GGCACCACGGTCACCGTCTCCTCAGGTGGTGGTGGTTCTGGCGGCGGC<br>GGCTCCGGTGGTGGTGGTTCTGACGTCGTGATGACTCAGTCTCCACTC<br>TCCCTGCCCGTCACCCTTGGAGAGCCGGCCTCCATCTCCTGCAGGTCT<br>AGTCAAAGCCTCGTATACAGTAACGGAAACACCTACTTGCATTGGTAT<br>CAACAGAAGCCAGGCCAATCTCCAAGACTCCTAATTTATAAGGTTTCT<br>AACCGGTTCTCTGGGGTCCCAGACAGATTCAGCGGCAGTGGGTCAGGC |

| SEQ ID NO. | DESIGNATION | SOURCE | TYPE | SEQUENCE |
|---|---|---|---|---|
| | | | | ACTGATTTCACACTGAAAATCAGCAGGGTGGAGGCTGAGGATGTTGGG<br>GTTTATTTCTGCTCTCAAAGTACACATGTTCCGTACACGTTTGGCCAG<br>GGGACCAAGCTGGAGATCAAA |
| 251. | PM52H3 VH-VL × I2C<br>VH-VL | artificial | aa | QVQLVQSGAEVKKPGASVKLSCKASGYTFTYFDINWVRQTPEQGLEWM<br>GGISPGDGNTNYNENFKGRVTMTRDTSKSTAYMELSRLRSDDTAVYYC<br>ARDGNFPYYAMDSWGQGTTVTVSSGGGGSGGGGSGGGGSDVVMTQSPL<br>SLPVTLGEPASISCRSSQSLVYSNGNTYLHWYQQKPGQSPRLLIYKVS<br>NRFSGVPDRFSGSGSGTDFTLKISRVEAEDVGVYFCSQSTHVPYTFGQ<br>GTKLEIKSGGGGSEVQLVESGGGLVQPGGSLKLSCAASGFTFNKYAMN<br>WVRQAPGKGLEWVARIRSKYNNYATYYADSVKDRFTISRDDSKNTAYL<br>QMNNLKTEDTAVYYCVRHGNFGNSYISYWAYWGQGTLVTVSSGGGGSG<br>GGGSGGGGSQTVVTQEPSLTVSPGGTVTLTCGSSTGAVTSGNYPNWVQ<br>QKPGQAPRGLIGGTKFLAPGTPARFSGSLLGGKAALTLSGVQPEDEAE<br>YYCVLWYSNRWVFGGGTKLTVL |
| 252. | PM52H3 VH-VL × I2C<br>VH-VL | artificial | nt | CAGGTGCAGCTGGTCCAGTCTGGCGCCGAAGTGAAGAAGCCTGGCGCC<br>TCCGTGAAGCTGTCCTGCAAGGCCTCCGGCTACACCTTCACCTACTTC<br>GACATCAACTGGGTGCGGCAGACGCCTGAGCAGGGCCTGGAATGGATG<br>GGCGGCATCTCCCCTGGCGACGGCAACACCAACTACAACGAGAACTTC<br>AAGGGCAGGGTCACAATGACCAGAGACACGTCCAAATCCACCGCCTAC<br>ATGGAGCTGTCCCGGCTGAGATCTGACGACACCGCCGTGTACTACTGC<br>GCCAGGGACGGCAACTTCCCTTACTACGCCATGGACTCTTGGGGCCAG<br>GGCACCACGGTCACCGTCTCCTCAGGTGGTGGTGGTTCTGGCGGCGGC<br>GGCTCCGGTGGTGGTGGTTCTGACGTCGTGATGACTCAGTCTCCACTC<br>TCCCTGCCCGTCACCCTTGGAGAGCCGGCCTCCATCTCCTGCAGGTCT<br>AGTCAAAGCCTCGTATACAGTAACGGAAACACCTACTTGCATTGGTAT<br>CAACAGAAGCCAGGCCAATCTCCAAGACTCCTAATTTATAAGGTTTCT<br>AACCGGTTCTCTGGGGTCCCAGACAGATTCAGCGGCAGTGGGTCAGGC<br>ACTGATTTCACACTGAAAATCAGCAGGGTGGAGGCTGAGGATGTTGGG<br>GTTTATTTCTGCTCTCAAAGTACACATGTTCCGTACACGTTTGGCCAG<br>GGGACCAAGCTGGAGATCAAATCCGGAGGTGGTGGATCCGAGGTGCAG<br>CTGGTCGAGTCTGGAGGAGGATTGGTGCAGCCTGGAGGGTCATTGAAA<br>CTCTCATGTGCAGCCTCTGGATTCACCTTCAATAAGTACGCCATGAAC<br>TGGGTCCGCCAGGCTCCAGGAAAGGGTTTGGAATGGGTTGCTCGCATA<br>AGAAGTAAATATAATAATTATGCAACATATTATGCCGATTCAGTGAAA<br>GACAGGTTCACCATCTCCAGAGATGATTCAAAAAACACTGCCTATCTA<br>CAAATGAACAACTTGAAAACTGAGGACACTGCCGTGTACTACTGTGTG<br>AGACATGGGAACTTCGGTAATAGCTACATATCCTACTGGGCTTACTGG<br>GGCCAAGGGACTCTGGTCACCGTCTCCTCAGGTGGTGGTGGTTCTGGC<br>GGCGGCGGCTCCGGTGGTGGTTCTCAGACTGTTGTGACTCAGGAA<br>CCTTCACTCACCGTATCACCTGGTGGAACAGTCACACTCACTTGTGGC<br>TCCTCGACTGGGGCTGTTACATCTGGCAACTACCCAAACTGGGTCCAA<br>CAAAAACCAGGTCAGGCACCCCGTGGTCTAATAGGTGGGACTAAGTTC<br>CTCGCCCCCGGTACTCCTGCCAGATTCTCAGGCTCCCTGCTTGGAGGC<br>AAGGCTGCCCTCACCCTCTCAGGGGTACAGCCAGAGGATGAGGCAGAA<br>TATTACTGTGTTCTATGGTACAGCAACCGCTGGGTGTTCGGTGGAGGA<br>ACCAAACTGACTGTCCTA |
| 253. | PM75A10-VH | artificial | aa | QVQLVQSGAEVKKPGASVKLSCKASGYTFTYFDINWVRQTPEQGLEWM<br>GGISPGDGNTNYNENFKGRVTMTRDTSSSTAYMELSRLRSDDTAVYYC<br>ARDGNFPYYAMVNWGQGTTVTVSS |
| 254. | PM75A10-HCDR1 | artificial | aa | YFDIN |
| 255. | PM75A10-HCDR2 | artificial | aa | GISPGDGNTNYNENFKG |
| 256. | PM75A10-HCDR3 | artificial | aa | DGNFPYYAMVN |
| 257. | PM75A10-VH | artificial | nt | CAGGTGCAGCTGGTCCAGTCTGGCGCCGAAGTGAAGAAGCCTGGCGCC<br>TCCGTGAAGCTGTCCTGCAAGGCCTCCGGCTACACCTTCACCTACTTC<br>GACATCAACTGGGTGCGGCAGACGCCTGAGCAGGGCCTGGAATGGATG<br>GGCGGCATCTCCCCTGGCGACGGCAACACCAACTACAACGAGAACTTC<br>AAGGGCAGGGTCACAATGACCAGAGACACGTCCTCATCCACCGCCTAC<br>ATGGAGCTGTCCCGGCTGAGATCTGACGACACCGCCGTGTACTACTGC<br>GCCAGGGACGGCAACTTCCCTTACTACGCGATGGTCAACTGGGGCCAG<br>GGCACCACGGTCACCGTCTCCTCA |
| 258. | PM75A10-VL | artificial | aa | DVVMTQSPLSLPVTLGEPASISCRSSQSLVYSNGNTYLHWYQQKPGQS<br>PRLLIYKVSNRFSGVPDRFSGSGSGTDFTLKISRVEAEDVGVYFCSQS<br>THVPYTFGQGTKLEIK |
| 259. | PM75A10-LCDR1 | artificial | aa | RSSQSLVYSNGNTYLH |
| 260. | PM75A10-LCDR2 | artificial | aa | KVSNRFS |
| 261. | PM75A10-LCDR3 | artificial | aa | SQSTHVPYT |

| SEQ ID NO. | DESIGNATION | SOURCE | TYPE | SEQUENCE |
|---|---|---|---|---|
| 262. | PM75A10-VL | artificial | nt | GACGTCGTGATGACTCAGTCTCCACTCTCCCTGCCCGTCACCCTTGGA GAGCCGGCCTCCATCTCCTGCAGGTCTAGTCAAAGCCTCGTATACAGT AACGGAAACACCTACTTGCATTGGTATCAACAGAAGCCAGGCCAATCT CCAAGACTCCTAATTTATAAGGTTTCTAACCGGTTCTCTGGGGTCCCA GACAGATTCAGCGGCAGTGGGTCAGGCACTGATTTCACACTGAAAATC AGCAGGGTGGAGGCTGAGGATGTTGGGGTTTATTTCTGTTCTCAAAGT ACACATGTTCCGTACACGTTTGGCCAGGGGACCAAGCTGGAGATCAAA |
| 263. | PM75A10-VH-VL | artificial | aa | QVQLVQSGAEVKKPGASVKLSCKASGYTFTYFDINWVRQTPEQGLEWM GGISPGDGNTNYNENFKGRVTMTRDTSSSTAYMELSRLRSDDTAVYYC ARDGNFPYYAMVNWGQGTTVTVSSGGGGSGGGGSGGGGSDVVMTQSPL SLPVTLGEPASISCRSSQSLVYSNGNTYLHWYQQKPGQSPRLLIYKVS NRFSGVPDRFSGSGSGTDFTLKISRVEAEDVGVYFCSQSTHVPYTFGQ GTKLEIK |
| 264. | PM75A10-VH-VL | artificial | nt | CAGGTGCAGCTGGTCCAGTCTGGCGCCGAAGTGAAGAAGCCTGGCGCC TCCGTGAAGCTGTCCTGCAAGGCCTCCGGCTACACCTTCACCTACTTC GACATCAACTGGGTGCGGCAGACGCCTGAGCAGGGCCTGGAATGGATG GGCGGCATCTCCCCTGGCGACGGCAACACCAACTACAACGAGAACTTC AAGGGCAGGGTCACAATGACCAGAGACACGTCCTCATCCACCGCCTAC ATGGAGCTGTCCCGGCTGAGATCTGACGACACCGCCGTGTACTACTGC GCCAGGGACGGCAACTTCCCTTACTACGCGATGGTCAACTGGGGCCAG GGCACCACGGTCACCGTCTCCTCAGGTGGTGGTGGTTCTGGCGGCGGC GGCTCCGGTGGTGGTGGTTCTGACGTCGTGATGACTCAGTCTCCACTC TCCCTGCCCGTCACCCTTGGAGAGCCGGCCTCCATCTCCTGCAGGTCT AGTCAAAGCCTCGTATACAGTAACGGAAACACCTACTTGCATTGGTAT CAACAGAAGCCAGGCCAATCTCCAAGACTCCTAATTTATAAGGTTTCT AACCGGTTCTCTGGGGTCCCAGACAGATTCAGCGGCAGTGGGTCAGGC ACTGATTTCACACTGAAAATCAGCAGGGTGGAGGCTGAGGATGTTGGG GTTTATTTCTGTTCTCAAAGTACACATGTTCCGTACACGTTTGGCCAG GGGACCAAGCTGGAGATCAAA |
| 265. | PM75A10 VH-VL x I2C VH-VL | artificial | aa | QVQLVQSGAEVKKPGASVKLSCKASGYTFTYFDINWVRQTPEQGLEWM GGISPGDGNTNYNENFKGRVTMTRDTSSSTAYMELSRLRSDDTAVYYC ARDGNFPYYAMVNWGQGTTVTVSSGGGGSGGGGSGGGGSDVVMTQSPL SLPVTLGEPASISCRSSQSLVYSNGNTYLHWYQQKPGQSPRLLIYKVS NRFSGVPDRFSGSGSGTDFTLKISRVEAEDVGVYFCSQSTHVPYTFGQ GTKLEIKSGGGGSEVQLVESGGGLVQPGGSLKLSCAASGFTFNKYAMN WVRQAPGKGLEWVARIRSKYNNYATYYADSVKDRFTISRDDSKNTAYL QMNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWVQ QKPGQAPRGLIGGTKFLAPGTPARFSGSLLGGKAALTLSGVQPEDEAE YYCVLWYSNRWVFGGGTKLTVL |
| 266. | PM75A10 VH-VL x I2C VH-VL | artificial | nt | CAGGTGCAGCTGGTCCAGTCTGGCGCCGAAGTGAAGAAGCCTGGCGCC TCCGTGAAGCTGTCCTGCAAGGCCTCCGGCTACACCTTCACCTACTTC GACATCAACTGGGTGCGGCAGACGCCTGAGCAGGGCCTGGAATGGATG GGCGGCATCTCCCCTGGCGACGGCAACACCAACTACAACGAGAACTTC AAGGGCAGGGTCACAATGACCAGAGACACGTCCTCATCCACCGCCTAC ATGGAGCTGTCCCGGCTGAGATCTGACGACACCGCCGTGTACTACTGC GCCAGGGACGGCAACTTCCCTTACTACGCGATGGTCAACTGGGGCCAG GGCACCACGGTCACCGTCTCCTCAGGTGGTGGTGGTTCTGGCGGCGGC GGCTCCGGTGGTGGTGGTTCTGACGTCGTGATGACTCAGTCTCCACTC TCCCTGCCCGTCACCCTTGGAGAGCCGGCCTCCATCTCCTGCAGGTCT AGTCAAAGCCTCGTATACAGTAACGGAAACACCTACTTGCATTGGTAT CAACAGAAGCCAGGCCAATCTCCAAGACTCCTAATTTATAAGGTTTCT AACCGGTTCTCTGGGGTCCCAGACAGATTCAGCGGCAGTGGGTCAGGC ACTGATTTCACACTGAAAATCAGCAGGGTGGAGGCTGAGGATGTTGGG GTTTATTTCTGTTCTCAAAGTACACATGTTCCGTACACGTTTGGCCAG GGGACCAAGCTGGAGATCAAATCCGGAGGTGGTGGATCCGAGGTGCAG CTGGTCGAGTCTGGAGGAGGATTGGTGCAGCCTGGAGGGTCATTGAAA CTCTCATGTGCAGCCTCTGGATTCACCTTCAATAAGTACGCCATGAAC TGGGTCCGCCAGGCTCCAGGAAAGGGTTTGGAATGGGTTGCTCGCATA AGAAGTAAATATAATAATTATGCAACATATTATGCCGATTCAGTGAAA GACAGGTTCACCATCTCCAGAGATGATTCAAAAAACACTGCCTATCTA CAAATGAACAACTTGAAAACTGAGGACACTGCCGTGTACTACTGTGTG AGACATGGGAACTTCGGTAATAGCTACATATCCTACTGGGCTTACTGG GGCCAAGGGACTCTGGTCACCGTCTCCTCAGGTGGTGGTGGTTCTGGC GGCGGCGGCTCCGGTGGTGGTGGTTCTCAGACTGTTGTGACTCAGGAA CCTTCACTCACCGTATCACCTGGTGGAACAGTCACACTCACTTGTGGC TCCTCGACTGGGGCTGTTACATCTGGCAACTACCCAAACTGGGTCCAA CAAAAACCAGGTCAGGCACCCCGTGGTCTAATAGGTGGGACTAAGTTC CTCGCCCCCGGTACTCCTGCCAGATTCTCAGGCTCCCTGCTTGGAGGC AAGGCTGCCCTCACCCTCTCAGGGGTACAGCCAGAGGATGAGGCAGAA TATTACTGTGTTCTATGGTACAGCAACCGCTGGGTGTTCGGTGGAGGA ACCAAACTGACTGTCCTA |

-continued

| SEQ ID NO. | DESIGNATION | SOURCE | TYPE | SEQUENCE |
|---|---|---|---|---|
| 267. | PM91B6-VH | artificial | aa | QVQLVQSGAEVKKPGASVKLSCKASGYTFTYFDINWVRQTPEQGLEWM GGISPGDGNTNYNENFKGRVTMTRDTSSSTAYMELSRLRSDDTAVYYC ARDGNFPYYALTNWGQGTTVTVSS |
| 268. | PM91B6-HCDR1 | artificial | aa | YFDIN |
| 269. | PM91B6-HCDR2 | artificial | aa | GISPGDGNTNYNENFKG |
| 270. | PM91B6-HCDR3 | artificial | aa | DGNFPYYALTN |
| 271. | PM91B6-VH | artificial | nt | CAGGTGCAGCTGGTCCAGTCTGGCGCCGAAGTGAAGAAGCCTGGCGCC TCCGTGAAGCTGTCCTGCAAGGCCTCCGGCTACACCTTCACCTACTTC GACATCAACTGGGTGCGGCAGACGCCTGAGCAGGGCCTGGAATGGATG GGCGGCATCTCCCCTGGCGACGGCAACACCAACTACAACGAGAACTTC AAGGGCCAGGGTCACAATGACCAGAGACACGTCCTCATCCACCGCCTAC ATGGAGCTGTCCCGGCTGAGATCTGACGACACCGCCGTGTACTACTGC GCCAGGGACGGCAACTTCCCTTACTACGCCCTGACCAACTGGGGCCAG GGCACCACGGTCACCGTCTCCTCA |
| 272. | PM91B6-VL | artificial | aa | DVVMTQSPLSLPVTLGEPASISCRSSQSLVYSNGNTYLHWYQQKPGQS PRLLIYKVSNRFSGVPDRFSGSGSGTDFTLKISRVEAEDVGVYFCSQS THVPYTFGQGTKLEIK |
| 273. | PM91B6-LCDR1 | artificial | aa | RSSQSLVYSNGNTYLH |
| 274. | PM91B6-LCDR2 | artificial | aa | KVSNRFS |
| 275. | PM91B6-LCDR3 | artificial | aa | SQSTHVPYT |
| 276. | PM91B6-VL | artificial | nt | GACGTCGTGATGACTCAGTCTCCACTCTCCCTGCCCGTCACCCTTGGA GAGCCGGCCTCCATCTCCTGCAGGTCTAGTCAAAGCCTCGTATACAGT AACGGAAACACCTACTTGCATTGGTATCAACAGAAGCCAGGCCAATCT CCAAGACTCCTAATTTATAAGGTTTCTAACCGGTTCTCTGGGGTCCCA GACAGATTCAGCGGCAGTGGGTCAGGCACTGATTTCACACTGAAAATC AGCAGGGTGGAGGCTGAGGATGTTGGGGTTTATTTCTGTTCTCAAAGT ACACATGTTCCGTACACGTTTGGCCAGGGGACCAAGCTGGAGATCAAA |
| 277. | PM91B6-VH-VL | artificial | aa | QVQLVQSGAEVKKPGASVKLSCKASGYTFTYFDINWVRQTPEQGLEWM GGISPGDGNTNYNENFKGRVTMTRDTSSSTAYMELSRLRSDDTAVYYC ARDGNFPYYALTNWGQGTTVTVSSGGGGSGGGGSGGGGSDVVMTQSPL SLPVTLGEPASISCRSSQSLVYSNGNTYLHWYQQKPGQSPRLLIYKVS NRFSGVPDRFSGSGSGTDFTLKISRVEAEDVGVYFCSQSTHVPYTFGQ GTKLEIK |
| 278. | PM91B6-VH-VL | artificial | nt | CAGGTGCAGCTGGTCCAGTCTGGCGCCGAAGTGAAGAAGCCTGGCGCC TCCGTGAAGCTGTCCTGCAAGGCCTCCGGCTACACCTTCACCTACTTC GACATCAACTGGGTGCGGCAGACGCCTGAGCAGGGCCTGGAATGGATG GGCGGCATCTCCCCTGGCGACGGCAACACCAACTACAACGAGAACTTC AAGGGCCAGGGTCACAATGACCAGAGACACGTCCTCATCCACCGCCTAC ATGGAGCTGTCCCGGCTGAGATCTGACGACACCGCCGTGTACTACTGC GCCAGGGACGGCAACTTCCCTTACTACGCCCTGACCAACTGGGGCCAG GGCACCACGGTCACCGTCTCCTCAGGTGGTGGTGGTTCTGGCGGCGGC GGCTCCGGTGGTGGTGGTTCTGACGTCGTGATGACTCAGTCTCCACTC TCCCTGCCCGTCACCCTTGGAGAGCCGGCCTCCATCTCCTGCAGGTCT AGTCAAAGCCTCGTATACAGTAACGGAAACACCTACTTGCATTGGTAT CAACAGAAGCCAGGCCAATCTCCAAGACTCCTAATTTATAAGGTTTCT AACCGGTTCTCTGGGGTCCCAGACAGATTCAGCGGCAGTGGGTCAGGC ACTGATTTCACACTGAAAATCAGCAGGGTGGAGGCTGAGGATGTTGGG GTTTATTTCTGTTCTCAAAGTACACATGTTCCGTACACGTTTGGCCAG GGGACCAAGCTGGAGATCAAA |
| 279. | PM91B6 VH-VL × I2C VH-VL | artificial | aa | QVQLVQSGAEVKKPGASVKLSCKASGYTFTYFDINWVRQTPEQGLEWM GGISPGDGNTNYNENFKGRVTMTRDTSSSTAYMELSRLRSDDTAVYYC ARDGNFPYYALTNWGQGTTVTVSSGGGGSGGGGSGGGGSDVVMTQSPL SLPVTLGEPASISCRSSQSLVYSNGNTYLHWYQQKPGQSPRLLIYKVS NRFSGVPDRFSGSGSGTDFTLKISRVEAEDVGVYFCSQSTHVPYTFGQ GTKLEIKSGGGGSEVQLVESGGGLVQPGGSLKLSCAASGFTFNKYAMN WVRQAPGKGLEWVARIRSKYNNYATYYADSVKDRFTISRDDSKNTAYL QMNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWVQ QKPGQAPRGLIGGTKFLAPGTPARFSGSLLGGKAALTLSGVQPEDEAE YYCVLWYSNRWVFGGGTKLTVL |
| 280. | PM91B6 VH-VL × I2C VH-VL | artificial | nt | CAGGTGCAGCTGGTCCAGTCTGGCGCCGAAGTGAAGAAGCCTGGCGCC TCCGTGAAGCTGTCCTGCAAGGCCTCCGGCTACACCTTCACCTACTTC GACATCAACTGGGTGCGGCAGACGCCTGAGCAGGGCCTGGAATGGATG |

| SEQ ID NO. | DESIGNATION | SOURCE | TYPE | SEQUENCE |
|---|---|---|---|---|
| | | | | GGCGGCATCTCCCCTGGCGACGGCAACACCAACTACAACGAGAACTTC |
| | | | | AAGGGCAGGGTCACAATGACCAGAGACACGTCCTCATCCACCGCCTAC |
| | | | | ATGGAGCTGTCCCGGCTGAGATCTGACGACACCGCCGTGTACTACTGC |
| | | | | GCCAGGGACGGCAACTTCCCTTACTACGCCCTGACCAACTGGGGCCAG |
| | | | | GGCACCACGGTCACCGTCTCCTCAGGTGGTGGTGGTTCTGGCGGCGGC |
| | | | | GGCTCCGGTGGTGGTGGTTCTGACGTCGTGATGACTCAGTCTCCACTC |
| | | | | TCCCTGCCCGTCACCCTTGGAGAGCCGGCCTCCATCTCCTGCAGGTCT |
| | | | | AGTCAAAGCCTCGTATACAGTAACGGAAACACCTACTTGCATTGGTAT |
| | | | | CAACAGAAGCCAGGCCAATCTCCAAGACTCCTAATTTATAAGGTTTCT |
| | | | | AACCGGTTCTCTGGGGTCCCAGACAGATTCAGCGGCAGTGGGTCAGGC |
| | | | | ACTGATTTCACACTGAAAATCAGCAGGGTGGAGGCTGAGGATGTTGGG |
| | | | | GTTTATTTCTGTTCTCAAAGTACACATGTTCCGTACACGTTTGGCCAG |
| | | | | GGGACCAAGCTGGAGATCAAATCCGGAGGTGGTGGATCCGAGGTGCAG |
| | | | | CTGGTCGAGTCTGGAGGAGGATTGGTGCAGCCTGGAGGGTCATTGAAA |
| | | | | CTCTCATGTGCAGCCTCTGGATTCACCTTCAATAAGTACGCCATGAAC |
| | | | | TGGGTCCGCCAGGCTCCAGGAAAGGGTTTGGAATGGGTTGCTCGCATA |
| | | | | AGAAGTAAATATAATAATTATGCAACATATTATGCCGATTCAGTGAAA |
| | | | | GACAGGTTCACCATCTCCAGAGATGATTCAAAAAACACTGCCTATCTA |
| | | | | CAAATGAACAACTTGAAAACTGAGGACACTGCCGTGTACTACTGTGTG |
| | | | | AGACATGGGAACTTCGGTAATAGCTACATATCCTACTGGGCTTACTGG |
| | | | | GGCCAAGGGACTCTGGTCACCGTCTCCTCAGGTGGTGGTGGTTCTGGC |
| | | | | GGCGGCGGCTCCGGTGGTGGTGGTTCTGACGTCGTGTGACTCAGGAA |
| | | | | CCTTCACTCACCGTATCACCTGGTGGAACAGTCACACTCACTTGTGGC |
| | | | | TCCTCGACTGGGGCTGTTACATCTGGCAACTACCCAAACTGGGTCCAA |
| | | | | CAAAAACCAGGTCAGGCACCCCGTGGTCTAATAGGTGGGACTAAGTTC |
| | | | | CTCGCCCCCGGTACTCCTGCCAGATTCTCAGGCTCCCTGCTTGGAGGC |
| | | | | AAGGCTGCCCTCACCCTCTCAGGGGTACAGCCAGAGGATGAGGCAGAA |
| | | | | TATTACTGTGTTCTATGGTACAGCAACCGCTGGGTGTTCGGTGGAGGA |
| | | | | ACCAAACTGACTGTCCTA |
| 281. | PM83A12-VH | artificial | aa | QVQLVESGGGLVKPGESLRLSCAASGFTFSDYYMYWVRQAPGKGLEWV |
| | | | | AIISDGGYYTYYSDIIKGRFTISRDNAKNSLYLQTNSLKAEDTAVYYC |
| | | | | ARGFPLLRHGAFDLWGQGTLVTVSS |
| 282. | PM83A12-HCDR1 | artificial | aa | DYYMY |
| 283. | PM83A12-HCDR2 | artificial | aa | IISDGGYYTYYSDIIKG |
| 284. | PM83A12-HCDR3 | artificial | aa | GFPLLRHGAFDL |
| 285. | PM83A12-VH | artificial | nt | CAGGTGCAGCTGGTCGAGTCTGGCGGCGGACTGGTGAAGCCTGGCGAG |
| | | | | TCCCTGAGGCTGTCCTGTGCCGCCTCCGGCTTCACCTTCTCCGACTAC |
| | | | | TACATGTACTGGGTCCGCCAGGCCCCTGGGAAGGGGCTGGAATGGGTG |
| | | | | GCCATCATCTCCGACGGCGGCTACTACACCTACTACTCCGACATCATC |
| | | | | AAGGGCCGGTTCACCATCTCCCGGGACAATGCCAAGAACAGCCTGTAC |
| | | | | CTGCAGACGAACTCCCTGAAGGCCGAGGACACCGCCGTGTACTACTGC |
| | | | | GCCCGGGGCTTCCCTCTGCTGAGACACGGCGCCTTCGACCTCTGGGGC |
| | | | | CAGGGCACCCTGGTCACCGTCTCCTCA |
| 286. | PM83A12-VL | artificial | aa | DIQMTQSPSSLSASVGDRVTITCKASQNVDTNVAWYQQKPGQAPKSLI |
| | | | | YSASYRYSDVPSRFSGSASGTDFTLTISSVQSEDFATYYCQQYDSYPY |
| | | | | TFGGGTKLEIK |
| 287. | PM83A12-LCDR1 | artificial | aa | KASQNVDTNVA |
| 288. | PM83A12-LCDR2 | artificial | aa | SASYRYS |
| 289. | PM83A12-LCDR3 | artificial | aa | QQYDSYPYT |
| 290. | PM83A12-VL | artificial | nt | GACATCCAGATGACCCAGTCCCCCAGCTCCCTGTCCGCCTCCGTGGGC |
| | | | | GACAGAGTGACCATCACCTGCAAGGCCTCCCAGAACGTGGACACCAAC |
| | | | | GTGGCCTGGTATCAGCAGAAGCCCGGCCAGGCCCCTAAGTCCCTGATC |
| | | | | TACTCCGCCTCCTACCGGTACTCTGACGTGCCTTCCCGGTTCTCCGGC |
| | | | | TCCGCGTCCGGCACCGACTTCACCCTGACCATCTCCAGCGTGCAGTCT |
| | | | | GAGGACTTCGCCACGTACTACTGCCAGCAGTACGACTCCTACCCTTAC |
| | | | | ACCTTCGGCGGAGGGACCAAGCTGGAAATCAAG |
| 291. | PM83A12-VH-VL | artificial | aa | QVQLVESGGGLVKPGESLRLSCAASGFTFSDYYMYWVRQAPGKGLEWV |
| | | | | AIISDGGYYTYYSDIIKGRFTISRDNAKNSLYLQTNSLKAEDTAVYYC |
| | | | | ARGFPLLRHGAFDLWGQGTLVTVSSGGGGSGGGGSGGGGSDIQMTQSP |
| | | | | SSLSASVGDRVTITCKASQNVDTNVAWYQQKPGQAPKSLIYSASYRYS |
| | | | | DVPSRFSGSASGTDFTLTISSVQSEDFATYYCQQYDSYPYTFGGGTKL |
| | | | | EIK |
| 292. | PM83A12-VH-VL | artificial | nt | CAGGTGCAGCTGGTCGAGTCTGGCGGCGGACTGGTGAAGCCTGGCGAG |
| | | | | TCCCTGAGGCTGTCCTGTGCCGCCTCCGGCTTCACCTTCTCCGACTAC |
| | | | | TACATGTACTGGGTCCGCCAGGCCCCTGGGAAGGGGCTGGAATGGGTG |

| SEQ ID NO. | DESIGNATION | SOURCE | TYPE | SEQUENCE |
|---|---|---|---|---|
| | | | | GCCATCATCTCCGACGGCGGCTACTACACCTACTACTCCGACATCATC AAGGGCCGGTTCACCATCTCCCGGGACAATGCCAAGAACAGCCTGTAC CTGCAGACGAACTCCCTGAAGGCCGAGGACACCGCCGTGTACTACTGC GCCCGGGGCTTCCCTCTGCTGAGACACGGCGCCTTCGACCTCTGGGGC CAGGGCACCCTGGTCACCGTCTCCTCAGGTGGTGGTGGTTCTGGCGGC GGCGGCTCCGGTGGTGGTGGTTCTGACATCCAGATGACCCAGTCCCCC AGCTCCCTGTCCGCCTCCGTGGGCGACAGAGTGACCATCACCTGCAAG GCCTCCCAGAACGTGGACACCAACGTGGCCTGGTATCAGCAGAAGCCC GGCCAGGCCCCTAAGTCCCTGATCTACTCCGCCTCCTACCGGTACTCT GACGTGCCTTCCCGGTTCTCCGGCTCCGCGTCCGGCACCGACTTCACC CTGACCATCTCCAGCGTGCAGTCTGAGGACTTCGCCACGTACTACTGC CAGCAGTACGACTCCTACCCTTACACCTTCGGCGGAGGGACCAAGCTG GAAATCAAG |
| 293. | PM83A12 VH-VL × I2C VH-VL | artificial | aa | QVQLVESGGGLVKPGESLRLSCAASGFTFSDYYMYWVRQAPGKGLEWV AIISDGGYYTYYSDIIKGRFTISRDNAKNSLYLQTNSLKAEDTAVYYC ARGFPLLRHGAFDLWGQGTLVTVSSGGGGSGGGGSGGGGSDIQMTQSP SSLSASVGDRVTITCKASQNVDTNVAWYQQKPGQAPKSLIYSASYRYS DVPSRFSGSASGTDFTLTISSVQSEDFATYYCQQYDSYPYTFGGGTKL EIKSGGGGSEVQLVESGGGLVQPGGSLKLSCAASGFTFNKYAMNWVRQ APGKGLEWVARIRSKYNNYATYYADSVKDRFTISRDDSKNTAYLQMNN LKTEDTAVYYCVRHGNFGNSYISYWAYWGQGTLVTVSSGGGGSGGGGS GGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCV LWYSNRWVFGGGTKLTVL |
| 294. | PM83A12 VH-VL × I2C VH-VL | artificial | nt | CAGGTGCAGCTGGTCGAGTCTGGCGGCGGACTGGTGAAGCCTGGCGAG TCCCTGAGGCTGTCCTGTGCCGCCTCCGGCTTCACCTTCTCCGACTAC TACATGTACTGGGTCCGCCAGGCCCCTGGGAAGGGGCTGGAATGGGTG GCCATCATCTCCGACGGCGGCTACTACACCTACTACTCCGACATCATC AAGGGCCGGTTCACCATCTCCCGGGACAATGCCAAGAACAGCCTGTAC CTGCAGACGAACTCCCTGAAGGCCGAGGACACCGCCGTGTACTACTGC GCCCGGGGCTTCCCTCTGCTGAGACACGGCGCCTTCGACCTCTGGGGC CAGGGCACCCTGGTCACCGTCTCCTCAGGTGGTGGTGGTTCTGGCGGC GGCGGCTCCGGTGGTGGTGGTTCTGACATCCAGATGACCCAGTCCCCC AGCTCCCTGTCCGCCTCCGTGGGCGACAGAGTGACCATCACCTGCAAG GCCTCCCAGAACGTGGACACCAACGTGGCCTGGTATCAGCAGAAGCCC GGCCAGGCCCCTAAGTCCCTGATCTACTCCGCCTCCTACCGGTACTCT GACGTGCCTTCCCGGTTCTCCGGCTCCGCGTCCGGCACCGACTTCACC CTGACCATCTCCAGCGTGCAGTCTGAGGACTTCGCCACGTACTACTGC CAGCAGTACGACTCCTACCCTTACACCTTCGGCGGAGGGACCAAGCTG GAAATCAAGTCCGGAGGTGGTGGATCCGAGGTGCAGCTGGTCGAGTCT GGAGGAGGATTGGTGCAGCCTGGAGGGTCATTGAAACTCTCATGTGCA GCCTCTGGATTCACCTTCAATAAGTACGCCATGAACTGGGTCCGCCAG GCTCCAGGAAAGGGTTTGGAATGGGTTGCTCGCATAAGAAGTAAATAT AATAATTATGCAACATATTATGCCGATTCAGTGAAAGACAGGTTCACC ATCTCCAGAGATGATTCAAAAAACACTGCCTATCTACAAATGAACAAC TTGAAAACTGAGGACACTGCCGTGTACTACTGTGTGAGACATGGGAAC TTCGGTAATAGCTACATATCCTACTGGGCTTACTGGGGCCAAGGGACT CTGGTCACCGTCTCCTCAGGTGGTGGTGGTTCTGGCGGCGGCGGCTCC GGTGGTGGTGGTTCTCAGACTGTTGTGACTCAGGAACCTTCACTCACC GTATCACCTGGTGGAACAGTCACACTCACTTGTGGCTCCTCGACTGGG GCTGTTACATCTGGCAACTACCCAAACTGGGTCCAACAAAAACCAGGT CAGGCACCCCGTGGTCTAATAGGTGGGACTAAGTTCCTCGCCCCCGGT ACTCCTGCCAGATTCTCAGGCTCCCTGCTTGGAGGCAAGGCTGCCCTC ACCCTCTCAGGGGTACAGCCAGAGGATGAGGCAGAATATTACTGTGTT CTATGGTACAGCAACCGCTGGGTGTTCGGTGGAGGAACCAAACTGACT GTCCTA |
| 295. | PM07F8MPF-VH | artificial | aa | QVQLVESGGGLVKPGESLRLSCAASGFTFSDYYMYWVRQAPGKGLEWV ASISDGGSNTYYSDIIKGRFTISRDNAKNSLYLQTNSLKAEDTAVYYC ARGFPLLRHGAFDLWGQGTLVTVSS |
| 296. | PM07F8MPF-HCDR1 | artificial | aa | DYYMY |
| 297. | PM07F8MPF-HCDR2 | artificial | aa | SISDGGSNTYYSDIIKG |
| 298. | PM07F8MPF-HCDR3 | artificial | aa | GFPLLRHGAFDL |
| 299. | PM07F8MPF-VH | artificial | nt | CAGGTGCAGCTGGTCGAGTCTGGCGGCGGACTGGTGAAGCCTGGCGAG TCCCTGAGGCTGTCCTGTGCCGCCTCCGGCTTCACCTTCTCCGACTAC TACATGTACTGGGTCCGCCAGGCCCCTGGGAAGGGGCTGGAATGGGTG GCCTCCATCTCCGACGGCGGCTCCAACACCTACTACTCCGACATCATC AAGGGCCGGTTCACCATCTCCCGGGACAACGCCAAGAACAGCCTGTAC CTGCAGACGAACTCCCTGAAGGCCGAGGACACCGCCGTGTACTACTGC GCCCGGGGCTTCCCTCTGCTGAGACACGGCGCCTTCGACCTCTGGGGC CAGGGCACCCTGGTCACCGTCTCCTCA |

| SEQ ID NO. | DESIGNATION | SOURCE | TYPE | SEQUENCE |
|---|---|---|---|---|
| 300. | PM07F8MPF-VL | artificial | aa | DIQMTQSPSSLSASVGDRVTITCRASQNVDTNVAWYQQKPGQAPKSLI<br>YSATYRYSDVPSRFSGSASGTDFTLTISSVQSEDFATYYCQQYNSYPY<br>TFGGGTKLEIK |
| 301. | PM07F8MPF-LCDR1 | artificial | aa | RASQNVDTNVA |
| 302. | PM07F8MPF-LCDR2 | artificial | aa | SATYRYS |
| 303. | PM07F8MPF-LCDR3 | artificial | aa | QQYNSYPYT |
| 304. | PM07F8MPF-VL | artificial | nt | GACATCCAGATGACCCAGTCCCCCAGCTCCCTGTCCGCCTCCGTGGGC<br>GACAGAGTGACCATCACCTGCAGGGCCTCCCAGAACGTGGACACCAAC<br>GTGGCCTGGTATCAGCAGAAGCCCGGCCAGGCCCCTAAGTCCCTGATC<br>TACTCCGCCACCTACCGGTACTCTGACGTGCCTTCCCGGTTCTCCGGC<br>TCCGCGTCCGGCACCGACTTCACCCTGACCATCTCCAGCGTGCAGTCT<br>GAGGACTTCGCCACGTACTACTGCCAGCAGTACAACTCCTACCCTTAC<br>ACCTTCGGCGGAGGGACCAAGCTGGAAATCAAG |
| 305. | PM07F8MPF-VH-VL | artificial | aa | QVQLVESGGGLVKPGESLRLSCAASGFTFSDYYMYWVRQAPGKGLEWV<br>ASISDGGSNTYYSDIIKGRFTISRDNAKNSLYLQTNSLKAEDTAVYYC<br>ARGFPLLRHGAFDLWGQGTLVTVSSGGGGSGGGGSGGGGSDIQMTQSP<br>SSLSASVGDRVTITCRASQNVDTNVAWYQQKPGQAPKSLIYSATYRYS<br>DVPSRFSGSASGTDFTLTISSVQSEDFATYYCQQYNSYPYTFGGGTKL<br>EIK |
| 306. | PM07F8MPF-VH-VL | artificial | nt | CAGGTGCAGCTGGTCGAGTCTGGCGGCGGACTGGTGAAGCCTGGCGAG<br>TCCCTGAGGCTGTCCTGTGCCGCCTCCGGCTTCACCTTCTCCGACTAC<br>TACATGTACTGGGTCCGCCAGGCCCCTGGGAAGGGACTGGAATGGGTG<br>GCCTCCATCTCCGACGGCGGCTCCAACACCTACTACTCCGACATCATC<br>AAGGGCCGGTTCACCATCTCCCGGGACAACGCCAAGAACAGCCTGTAC<br>CTGCAGACGAACTCCCTGAAGGCCGAGGACACCGCCGTGTACTACTGC<br>GCCCGGGGCTTCCCTCTGCTGAGACACGGCGCCTTCGACCTCTGGGGC<br>CAGGGCACCCTGGTCACCGTCTCCTCAGGTGGTGGTGGTTCTGGCGGC<br>GGCGGCTCCGGTGGTGGTGGTTCTGACATCCAGATGACCCAGTCCCCC<br>AGCTCCCTGTCCGCCTCCGTGGGCGACAGAGTGACCATCACCTGCAGG<br>GCCTCCCAGAACGTGGACACCAACGTGGCCTGGTATCAGCAGAAGCCC<br>GGCCAGGCCCCTAAGTCCCTGATCTACTCCGCCACCTACCGGTACTCT<br>GACGTGCCTTCCCGGTTCTCCGGCTCCGCGTCCGGCACCGACTTCACC<br>CTGACCATCTCCAGCGTGCAGTCTGAGGACTTCGCCACGTACTACTGC<br>CAGCAGTACAACTCCTACCCTTACACCTTCGGCGGAGGGACCAAGCTG<br>GAAATCAAG |
| 307. | PM07F8MPF VH-VL × I2C VH-VL | artificial | aa | QVQLVESGGGLVKPGESLRLSCAASGFTFSDYYMYWVRQAPGKGLEWV<br>ASISDGGSNTYYSDIIKGRFTISRDNAKNSLYLQTNSLKAEDTAVYYC<br>ARGFPLLRHGAFDLWGQGTLVTVSSGGGGSGGGGSGGGGSDIQMTQSP<br>SSLSASVGDRVTITCRASQNVDTNVAWYQQKPGQAPKSLIYSATYRYS<br>DVPSRFSGSASGTDFTLTISSVQSEDFATYYCQQYNSYPYTFGGGTKL<br>EIKSGGGGSEVQLVESGGGLVQPGGSLKLSCAASGFTFNKYAMNWVRQ<br>APGKGLEWVARIRSKYNNYATYYADSVKDRFTISRDDSKNTAYLQMNN<br>LKTEDTAVYYCVRHGNFGNSYISYWAYWGQGTLVTVSSGGGGSGGGGS<br>GGGGSQTVVTQEPSLTVSPGGTVTLTCGSSTGAVTSGNYPNWVQQKPG<br>QAPRGLIGGTKFLAPGTPARFSGSLLGGKAALTLSGVQPEDEAEYYCV<br>LWYSNRWVFGGGTKLTVL |
| 308. | PM07F8MPF VH-VL × I2C VH-VL | artificial | nt | CAGGTGCAGCTGGTCGAGTCTGGCGGCGGACTGGTGAAGCCTGGCGAG<br>TCCCTGAGGCTGTCCTGTGCCGCCTCCGGCTTCACCTTCTCCGACTAC<br>TACATGTACTGGGTCCGCCAGGCCCCTGGGAAGGGACTGGAATGGGTG<br>GCCTCCATCTCCGACGGCGGCTCCAACACCTACTACTCCGACATCATC<br>AAGGGCCGGTTCACCATCTCCCGGGACAACGCCAAGAACAGCCTGTAC<br>CTGCAGACGAACTCCCTGAAGGCCGAGGACACCGCCGTGTACTACTGC<br>GCCCGGGGCTTCCCTCTGCTGAGACACGGCGCCTTCGACCTCTGGGGC<br>CAGGGCACCCTGGTCACCGTCTCCTCAGGTGGTGGTGGTTCTGGCGGC<br>GGCGGCTCCGGTGGTGGTGGTTCTGACATCCAGATGACCCAGTCCCCC<br>AGCTCCCTGTCCGCCTCCGTGGGCGACAGAGTGACCATCACCTGCAGG<br>GCCTCCCAGAACGTGGACACCAACGTGGCCTGGTATCAGCAGAAGCCC<br>GGCCAGGCCCCTAAGTCCCTGATCTACTCCGCCACCTACCGGTACTCT<br>GACGTGCCTTCCCGGTTCTCCGGCTCCGCGTCCGGCACCGACTTCACC<br>CTGACCATCTCCAGCGTGCAGTCTGAGGACTTCGCCACGTACTACTGC<br>CAGCAGTACAACTCCTACCCTTACACCTTCGGCGGAGGGACCAAGCTG<br>GAAATCAAGTCCGGAGGTGGTGGATCCGAGGTGCAGCTGGTCGAGTCT<br>GGAGGAGGATTGGTGCAGCCTGGAGGGTCATTGAAACTCTCATGTGCA<br>GCCTCTGGATTCACCTTCAATAAGTACGCCATGAACTGGGTCCGCCAG<br>GCTCCAGGAAAGGGTTTGGAATGGGTTGCTCGCATAAGAAGTAAATAT<br>AATAATTATGCAACATATTATGCCGATTCAGTGAAAGACAGGTTCACC<br>ATCTCCAGAGATGATTCAAAAAACACTGCCTATCTACAAATGAACAAC<br>TTGAAAACTGAGGACACTGCCGTGTACTACTGTGTGAGACATGGGAAC |

| SEQ ID NO. | DESIGNATION | SOURCE | TYPE | SEQUENCE |
|---|---|---|---|---|
| | | | | TTCGGTAATAGCTACATATCCTACTGGGCTTACTGGGGCCAAGGGACT<br>CTGGTCACCGTCTCCTCAGGTGGTGGTGGTTCTGGCGGCGGCGGCTCC<br>GGTGGTGGTGGTTCTCAGACTGTTGTGACTCAGGAACCTTCACTCACC<br>GTATCACCTGGTGGAACAGTCACACTCACTTGTGGCCTCCGACTGGG<br>GCTGTTACATCTGGCAACTACCCAAACTGGGTCCAACAAAAACCAGGT<br>CAGGGCACCCCGTGGTCTAATAGGTGGGACTAAGTTCCTCGCCCCGGT<br>ACTCCTGCCAGATTCTCAGGCTCCCTGCTTGGAGGCAAGGCTGCCCTC<br>ACCCTCTCAGGGGTACAGCCAGAGGATGAGGCAGAATATTACTGTGTT<br>CTATGGTACAGCAACCGCTGGGTGTTCGGTGGAGGAACCAAACTGACT<br>GTCCTA |
| 309. | PM07F8L1-VH | artificial | aa | QVQLVESGGGLVKPGESLRLSCAASGFTFSDYYMYWVRQAPGKGLEWV<br>ASISDGGSNTYYSDIIKGRFTISRDNAKNSLYLQMNSLKAEDTAVYYC<br>ARGFPLLRHGAFDYWGQGTLVTVSS |
| 310. | PM07F8L1-HCDR1 | artificial | aa | DYYMS |
| 311. | PM07F8L1-HCDR2 | artificial | aa | SISDGGSNTYYSDIIKG |
| 312. | PM07F8L1-HCDR3 | artificial | aa | GFPLLRHGAFDY |
| 313. | PM07F8L1-VH | artificial | nt | CAGGTGCAGCTGGTCGAGTCTGGCGGCGGACTGGTGAAGCCTGGCGAG<br>TCCCTGAGGCTGTCCTGTGCCGCCTCCGGCTTCACCTTCTCCGACTAC<br>TACATGTACTGGGTCCGCCAGGCCCCTGGGAAGGGGCTGGAATGGGTG<br>GCCTCCATCTCCGACGGCGGCTCCAACACCTACTACTCCGACATCATC<br>AAGGGCCGGTTCACCATCTCCCGGGACAACGCCAAGAACAGCCTGTAC<br>CTGCAGATGAACTCCCTGAAGGCCGAGGACACCGCCGTGTACTACTGC<br>GCCCGGGGCTTCCCTCTGCTGAGACACGGCGCCTTCGATTACTGGGGC<br>CAGGGCACCCTGGTCACCGTCTCCTCA |
| 314. | PM07F8L1-VL | artificial | aa | DIQMTQSPSSLSASVGDRVTITCKASQNVDTNVAWYQQKPGQAPKSLI<br>YSATYRYSDVPSRFSGSASGTDFTLTISSVQSEDFATYYCQQYNSYPY<br>TFGGGTKLEIK |
| 315. | PM07F8L1-LCDR1 | artificial | aa | KASQNVDTNVA |
| 316. | PM07F8L1-LCDR2 | artificial | aa | SATYRYS |
| 317. | PM07F8L1-LCDR3 | artificial | aa | QQYNSYPYT |
| 318. | PM07F8L1-VL | artificial | nt | GACATCCAGATGACCCAGTCCCCCAGCTCCCTGTCCGCCTCCGTGGGC<br>GACAGAGTGACCATCACCTGCAAGGCCTCCCAGAACGTGGACACCAAC<br>GTGGCCTGGTATCAGCAGAAGCCCGGCCAGGCCCCTAAGTCCCTGATC<br>TACTCCGCCACCTACCGGTACTCTGACGTGCCTTCCCGGTTCTCCGGC<br>TCCGCGTCCGGCACCGACTTCACCCTGACCATCTCCAGCGTGCAGTCT<br>GAGGACTTCGCCACGTACTACTGCCAGCAGTACAACTCCTACCCTTAC<br>ACCTTCGGCGGAGGGACCAAGCTGGAAATCAAG |
| 319. | PM07F8L1-VH-VL | artificial | aa | QVQLVESGGGLVKPGESLRLSCAASGFTFSDYYMYWVRQAPGKGLEWV<br>ASISDGGSNTYYSDIIKGRFTISRDNAKNSLYLQMNSLKAEDTAVYYC<br>ARGFPLLRHGAFDYWGQGTLVTVSSGGGGSGGGGSGGGGSDIQMTQSP<br>SSLSASVGDRVTITCKASQNVDTNVAWYQQKPGQAPKSLIYSATYRYS<br>DVPSRFSGSASGTDFTLTISSVQSEDFATYYCQQYNSYPYTFGGGTKL<br>EIK |
| 320. | PM07F8L1-VH-VL | artificial | nt | CAGGTGCAGCTGGTCGAGTCTGGCGGCGGACTGGTGAAGCCTGGCGAG<br>TCCCTGAGGCTGTCCTGTGCCGCCTCCGGCTTCACCTTCTCCGACTAC<br>TACATGTACTGGGTCCGCCAGGCCCCTGGGAAGGGGCTGGAATGGGTG<br>GCCTCCATCTCCGACGGCGGCTCCAACACCTACTACTCCGACATCATC<br>AAGGGCCGGTTCACCATCTCCCGGGACAACGCCAAGAACAGCCTGTAC<br>CTGCAGATGAACTCCCTGAAGGCCGAGGACACCGCCGTGTACTACTGC<br>GCCCGGGGCTTCCCTCTGCTGAGACACGGCGCCTTCGATTACTGGGGC<br>CAGGGCACCCTGGTCACCGTCTCCTCAGGTGGTGGTGGTTCTGGCGGC<br>GGCGGCTCCGGTGGTGGTGGTTCTGACATCCAGATGACCCAGTCCCCC<br>AGCTCCCTGTCCGCCTCCGTGGGCGACAGAGTGACCATCACCTGCAAG<br>GCCTCCCAGAACGTGGACACCAACGTGGCCTGGTATCAGCAGAAGCCC<br>GGCCAGGCCCCTAAGTCCCTGATCTACTCCGCCACCTACCGGTACTCT<br>GACGTGCCTTCCCGGTTCTCCGGCTCCGCGTCCGGCACCGACTTCACC<br>CTGACCATCTCCAGCGTGCAGTCTGAGGACTTCGCCACGTACTACTGC<br>CAGCAGTACAACTCCTACCCTTACACCTTCGGCGGAGGGACCAAGCTG<br>GAAATCAAG |
| 321. | PM07F8L1 VH-VL × I2C<br>VH-VL | artificial | aa | QVQLVESGGGLVKPGESLRLSCAASGFTFSDYYMYWVRQAPGKGLEWV<br>ASISDGGSNTYYSDIIKGRFTISRDNAKNSLYLQMNSLKAEDTAVYYC<br>ARGFPLLRHGAFDYWGQGTLVTVSSGGGGSGGGGSGGGGSDIQMTQSP<br>SSLSASVGDRVTITCKASQNVDTNVAWYQQKPGQAPKSLIYSATYRYS<br>DVPSRFSGSASGTDFTLTISSVQSEDFATYYCQQYNSYPYTFGGGTKL |

| SEQ ID NO. | DESIGNATION | SOURCE | TYPE | SEQUENCE |
|---|---|---|---|---|
| | | | | EIKSGGGGSEVQLVESGGGLVQPGGSLKLSCAASGFTFNKYAMNWVRQ APGKGLEWVARIRSKYNNYATYYADSVKDRFTISRDDSKNTAYLQMNN LKTEDTAVYYCVRHGNFGNSYISYWAYWGQGTLVTVSSGGGGSGGGGS GGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCV LWYSNRWVFGGGTKLTVL |
| 322. | PM07F8L1 VH-VL x I2C VH-VL | artificial | nt | CAGGTGCAGCTGGTCGAGTCTGGCGGCGGACTGGTGAAGCCTGGCGAG TCCCTGAGGCTGTCCTGTGCCGCCTCCGGCTTCACCTTCTCCGACTAC TACATGTACTGGGTCCGCCAGGCCCCTGGGAAGGGGCTGGAATGGGTG GCCTCCATCTCCGACGGCGGCTCCAACACCTACTACTCCGACATCATC AAGGGCCGGTTCACCATCTCCCGGGACAACGCCAAGAACAGCCTGTAC CTGCAGATGAACTCCCTGAAGGCCGAGGACACCGCCGTGTACTACTGC GCCCGGGGCTTCCCTCTGCTGAGACACGGCGCCTTCGATTACTGGGGC CAGGGCACCCTGGTCACCGTCTCCTCAGGTGGTGGTGGTTCTGGCGGC GGCGGCTCCGGTGGTGGTGGTTCTGACATCCAGATGACCCAGTCCCCC AGCTCCCTGTCCGCCTCCGTGGGCGACAGAGTGACCATCACCTGCAAG GCCTCCCAGAACGTGGACACCAACGTGGCCTGGTATCAGCAGAAGCCC GGCCAGGCCCCTAAGTCCCTGATCTACTCCGCCAGCTACCGGTACTCT GACGTGCCTTCCCGGTTCTCCGGCTCCGCGTCCGGCACCGACTTCACC CTGACCATCTCCAGCGTGCAGTCTGAGGACTTCGCCACGTACTACTGC CAGCAGTACAACTCCTACCCTTACACCTTCGGCGAGGGACCAAGCTG GAAATCAAGTCCGGAGGTGGTGGATCGAGGTGCAGCTGGTCGAGTCT GGAGGAGGATTGGTGCAGCCTGGAGGGTCATTGAAACTCTCATGTGCA GCCTCTGGATTCACCTTCAATAAGTACGCCATGAACTGGGTCCGCCAG GCTCCAGGAAAGGGTTTGGAATGGGTTGCTCGCATAAGAAGTAAATAT AATAATTATGCAACATATTATGCCGATTCAGTGAAAGACAGGTTCACC ATCTCCAGAGATGATTCAAAAAACACTGCCTATCTACAAATGAACAAC TTGAAAACTGAGGACACTGCCGTGTACTACTGTGTGAGACATGGGAAC TTCGGTAATAGCTACATATCCTACTGGGCTTACTGGGGCCAAGGGACT CTGGTCACCGTCTCCTCAGGTGGTGGTGGTTCTGGCGGCGGCGGCTCC GGTGGTGGTGGTTCTCAGACTGTTGTGACTCAGGAACCTTCACTCACC GTATCACCTGGTGGAACAGTCACACTCACTTGTGGCTCCTCGACTGGG GCTGTTACATCTGGCAACTACCCAAACTGGGTCCAACAAAAACCAGGT CAGGCACCCCGTGGTCTAATAGGTGGGACTAAGTTCCTCGCCCCCGGT ACTCCTGCCAGATTCTCAGGCTCCCTGCTTGGAGGCAAGGCTGCCCTC ACCCTCTCAGGGGTACAGCCAGAGGATGAGGCAGAATATTACTGTGTT CTATGGTACAGCAACCGCTGGGTGTTCGGTGGAGGAACCAAACTGACT GTCCT |
| 323. | PM07F8L2-VH | artificial | aa | QVQLVESGGGLVKPGESLRLSCAASGFTFSDYYMWVRQAPGKGLEWV ASISDGGSNTYYSDIIKGRFTISRDNAKNSLYLQMNSLKAEDTAVYYC ARGFPLLRHGAFDYWGQGTLVTVSS |
| 324. | PM07F8L2-HCDR1 | artificial | aa | DYYMS |
| 325. | PM07F8L2-HCDR2 | artificial | aa | SISDGGSNTYYSDIIKG |
| 326. | PM07F8L2-HCDR3 | artificial | aa | GFPLLRHGAFDY |
| 327. | PM07F8L2-VH | artificial | nt | CAGGTGCAGCTGGTCGAGTCTGGCGGCGGACTGGTGAAGCCTGGCGAG TCCCTGAGGCTGTCCTGTGCCGCCTCCGGCTTCACCTTCTCCGACTAC TACATGTACTGGGTCCGCCAGGCCCCTGGGAAGGGGCTGGAATGGGTG GCCTCCATCTCCGACGGCGGCTCCAACACCTACTACTCCGACATCATC AAGGGCCGGTTCACCATCTCCCGGGACAACGCCAAGAACAGCCTGTAC CTGCAGATGAACTCCCTGAAGGCCGAGGACACCGCCGTGTACTACTGC GCCCGGGGCTTCCCTCTGCTGAGACACGGCGCCTTCGATTACTGGGGC CAGGGCACCCTGGTCACCGTCTCCTCA |
| 328. | PM07F8L2-VL | artificial | aa | DIQMTQSPSSLSASVGDRVTITCRASQNVDTNVAWYQQKPGQAPKSLI YSASYRYSDVPSRFSGSASGTDFTLTISSVQSEDFATYYCQQYNSYPY TFGGGTKLEIK |
| 329. | PM07F8L2-LCDR1 | artificial | aa | RASQNVDTNVA |
| 330. | PM07F8L2-LCDR2 | artificial | aa | SASYRYS |
| 331. | PM07F8L2-LCDR3 | artificial | aa | QQYNSYPYT |
| 332. | PM07F8L2-VL | artificial | nt | GACATCCAGATGACCCAGTCCCCCAGCTCCCTGTCCGCCTCCGTGGGC GACAGAGTGACCATCACCTGCAGGGCCTCCCAGAACGTGGACACCAAC GTGGCCTGGTATCAGCAGAAGCCCGGCCAGGCCCCTAAGTCCCTGATC TACTCCGCCTCCTACCGGTACTCTGACGTGCCTTCCCGGTTCTCCGGC TCCGCGTCCGGCACCGACTTCACCCTGACCATCTCCAGCGTGCAGTCT GAGGACTTCGCCACGTACTACTGCCAGCAGTACAACTCCTACCCTTAC ACCTTCGGCGGAGGGACCAAGCTGGAAATCAAG |

-continued

| SEQ ID NO. | DESIGNATION | SOURCE | TYPE | SEQUENCE |
|---|---|---|---|---|
| 333. | PM07F8L2-VH-VL | artificial | aa | QVQLVESGGGLVKPGESLRLSCAASGFTFSDYYMYWVRQAPGKGLEWV ASISDGGSNTYYSDIIKGRFTISRDNAKNSLYLQMNSLKAEDTAVYYC ARGFPLLRHGAFDYWGQGTLVTVSSGGGGSGGGGSGGGGSDIQMTQSP SSLSASVGDRVTITCRASQNVDTNVAWYQQKPGQAPKSLIYSASYRYS DVPSRFSGSASGTDFTLTISSVQSEDFATYYCQQYNSYPYTFGGGTKL EIK |
| 334. | PM07F8L2-VH-VL | artificial | nt | CAGGTGCAGCTGGTCGAGTCTGGCGGCGGACTGGTGAAGCCTGGCGAG TCCCTGAGGCTGTCCTGTGCCGCCTCCGGCTTCACCTTCTCCGACTAC TACATGTACTGGGTCCGCCAGGCCCCTGGGAAGGGGCTGGAATGGGTG GCCTCCATCTCCGACGGCGGCTCCAACACCTACTACTCCGACATCATC AAGGGCCGGTTCACCATCTCCCGGGACAACGCCAAGAACAGCCTGTAC CTGCAGATGAACTCCCTGAAGGCCGAGGACACCGCCGTGTACTACTGC GCCCGGGGCTTCCCTCTGCTGAGACACGGCGCCTTCGATTACTGGGGC CAGGGCACCCTGGTCACCGTCTCCTCAGGTGGTGGTGGTTCTGGCGGC GGCGGCTCCGGTGGTGGTGGTTCTGACATCCAGATGACCCAGTCCCCC AGCTCCCTGTCCGCCTCCGTGGGCGACAGAGTGACCATCACCTGCAGG GCCTCCCAGAACGTGGACACCAACGTGGCCTGGTATCAGCAGAAGCCC GGCCAGGCCCCTAAGTCCCTGATCTACTCCGCCTCCTACCGGTACTCT GACGTGCCTTCCCGGTTCTCCGGCTCCGCGTCCGGCACCGACTTCACC CTGACCATCTCCAGCGTGCAGTCTGAGGACTTCGCCACGTACTACTGC CAGCAGTACAACTCCTACCCTTACACCTTCGGCGGAGGGACCAAGCTG GAAATCAAG |
| 335. | PM07F8L2 VH-VL × I2C VH-VL | artificial | aa | QVQLVESGGGLVKPGESLRLSCAASGFTFSDYYMYWVRQAPGKGLEWV ASISDGGSNTYYSDIIKGRFTISRDNAKNSLYLQMNSLKAEDTAVYYC ARGFPLLRHGAFDYWGQGTLVTVSSGGGGSGGGGSGGGGSDIQMTQSP SSLSASVGDRVTITCRASQNVDTNVAWYQQKPGQAPKSLIYSASYRYS DVPSRFSGSASGTDFTLTISSVQSEDFATYYCQQYNSYPYTFGGGTKL EIKSGGGGSEVQLVESGGGLVQPGGSLKLSCAASGFTFNKYAMNWVRQ APGKGLEWVARIRSKYNNYATYYADSVKDRFTISRDDSKNTAYLQMNN LKTEDTAVYYCVRHGNFGNSYISYWAYWGQGTLVTVSSGGGGSGGGGS GGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCV LWYSNRWVFGGGTKLTVL |
| 336. | PM07F8L2 VH-VL × I2C VH-VL | artificial | nt | CAGGTGCAGCTGGTCGAGTCTGGCGGCGGACTGGTGAAGCCTGGCGAG TCCCTGAGGCTGTCCTGTGCCGCCTCCGGCTTCACCTTCTCCGACTAC TACATGTACTGGGTCCGCCAGGCCCCTGGGAAGGGGCTGGAATGGGTG GCCTCCATCTCCGACGGCGGCTCCAACACCTACTACTCCGACATCATC AAGGGCCGGTTCACCATCTCCCGGGACAACGCCAAGAACAGCCTGTAC CTGCAGATGAACTCCCTGAAGGCCGAGGACACCGCCGTGTACTACTGC GCCCGGGGCTTCCCTCTGCTGAGACACGGCGCCTTCGATTACTGGGGC CAGGGCACCCTGGTCACCGTCTCCTCAGGTGGTGGTGGTTCTGGCGGC GGCGGCTCCGGTGGTGGTGGTTCTGACATCCAGATGACCCAGTCCCCC AGCTCCCTGTCCGCCTCCGTGGGCGACAGAGTGACCATCACCTGCAGG GCCTCCCAGAACGTGGACACCAACGTGGCCTGGTATCAGCAGAAGCCC GGCCAGGCCCCTAAGTCCCTGATCTACTCCGCCTCCTACCGGTACTCT GACGTGCCTTCCCGGTTCTCCGGCTCCGCGTCCGGCACCGACTTCACC CTGACCATCTCCAGCGTGCAGTCTGAGGACTTCGCCACGTACTACTGC CAGCAGTACAACTCCTACCCTTACACCTTCGGCGGAGGGACCAAGCTG GAAATCAAGTCCGGAGGTGGTGGATCGGAGGTGCAGCTGGTCGAGTCT GGAGGAGGATTGGTGCAGCCTGGAGGGTCATTGAAACTCTCATGTGCA GCCTCTGGATTCACCTTCAATAAGTACGCCATGAACTGGGTCCGCCAG GCTCCAGGAAAGGGTTTGGAATGGGTTGCTCGCATAAGAAGTAAATAT AATAATTATGCAACATATTATGCCGATTCAGTGAAAGACAGGTTCACC ATCTCCAGAGATGATTCAAAAAACACTGCCTATCTACAAATGAACAAC TTGAAAACTGAGGACACTGCCGTGTACTACTGTGTGAGACATGGGAAC TTCGGTAATAGCTACATATCCTACTGGGCTTACTGGGGCCAAGGGACT CTGGTCACCGTCTCCTCAGGTGGTGGTGGTTCTGGCGGCGGCGGCTCC GGTGGTGGTGGTTCTCAGACTGTTGTGACTCAGGAACCTTCACTCACC GTATCACCTGGTGGAACAGTCACACTCACTTGTGGCCTCTCGACTGGG GCTGTTACATCTGGCAACTACCCAAACTGGGTCCAACAAAAACCAGGT CAGGCACCCCGTGGTCTAATAGGTGGGACTAAGTTCCTCGCCCCCGGT ACTCCTGCCAGATTCTCAGGCTCCCTGCTTGGAGGCAAGGCTGCCCTC ACCCTCTCAGGGGTACAGCCAGAGGATGAGGCAGAATATTACTGTGTT CTATGGTACAGCAACCGCTGGGTGTTCGGTGGAGGAACCAAACTGACT GTCCT |
| 337. | PM07F8L3-VH | artificial | aa | QVQLVESGGGLVKPGESLRLSCAASGFTFSDYYMYWVRQAPGKGLEWV ASISDGGSNTYYSDIIKGRFTISRDNAKNSLYLQMNSLKAEDTAVYYC ARGFPLLRHGAFDYWGQGTLVTVSS |

-continued

| SEQ ID NO. | DESIGNATION | SOURCE | TYPE | SEQUENCE |
|---|---|---|---|---|
| 338. | PM07F8L3-HCDR1 | artificial | aa | DYYMS |
| 339. | PM07F8L3-HCDR2 | artificial | aa | SISDGGSNTYYSDIIKG |
| 340. | PM07F8L3-HCDR3 | artificial | aa | GFPLLRHGAFDY |
| 341. | PM07F8L3-VH | artificial | nt | CAGGTGCAGCTGGTCGAGTCTGGCGGCGGACTGGTGAAGCCTGGCGAG<br>TCCCTGAGGCTGTCCTGTGCCGCCTCCGGCTTCACCTTCTCCGACTAC<br>TACATGTACTGGGTCCGCCAGGCCCCTGGGAAGGGGCTGGAATGGGTG<br>GCCTCCATCTCCGACGGCGGCTCCAACACCTACTACTCCGACATCATC<br>AAGGGCCGGTTCACCATCTCCCGGGACAACGCCAAGAACAGCCTGTAC<br>CTGCAGATGAACTCCCTGAAGGCCGAGGACACCGCCGTGTACTACTGC<br>GCCCGGGGCTTCCCTCTGCTGAGACACGGCGCCTTCGATTACTGGGGC<br>CAGGGCACCCTGGTCACCGTCTCCTCA |
| 342. | PM07F8L3-VL | artificial | aa | DIQMTQSPSSLSASVGDRVTITCRASQNVDTNVAWYQQKPGQAPKSLI<br>YSATYRYSDVPSRFSGSASGTDFTLTISSVQSEDFATYYCQQYDSYPY<br>TFGGGTKLEIK |
| 343. | PM07F8L3-LCDR1 | artificial | aa | RASQNVDTNVA |
| 344. | PM07F8L3-LCDR2 | artificial | aa | SATYRYS |
| 345. | PM07F8L3-LCDR3 | artificial | aa | QQYDSYPYT |
| 346. | PM07F8L3-VL | artificial | nt | GACATCCAGATGACCCAGTCCCCCAGCTCCCTGTCCGCCTCCGTGGGC<br>GACAGAGTGACCATCACCTGCAGGGCCTCCCAGAACGTGGACACCAAC<br>GTGGCCTGGTATCAGCAGAAGCCCGGCCAGGCCCCTAAGTCCCTGATC<br>TACTCCGCCACCTACCGGTACTCTGACGTGCCTTCCCGGTTCTCCGGC<br>TCCGCGTCCGGCACCGACTTCACCCTGACCATCTCCAGCGTGCAGTCT<br>GAGGACTTCGCCACGTACTACTGCCAGCAGTACGACTCCTACCCTTAC<br>ACCTTCGGCGGAGGGACCAAGCTGGAAATCAAG |
| 347. | PM07F8L3-VH-VL | artificial | aa | QVQLVESGGGLVKPGESLRLSCAASGFTFSDYYMYWVRQAPGKGLEWV<br>ASISDGGSNTYYSDIIKGRFTISRDNAKNSLYLQMNSLKAEDTAVYYC<br>ARGFPLLRHGAFDYWGQGTLVTVSSGGGGSGGGGSGGGGSDIQMTQSP<br>SSLSASVGDRVTITCRASQNVDTNVAWYQQKPGQAPKSLIYSATYRYS<br>DVPSRFSGSASGTDFTLTISSVQSEDFATYYCQQYDSYPYTFGGGTKL<br>EIK |
| 348. | PM07F8L3-VH-VL | artificial | nt | CAGGTGCAGCTGGTCGAGTCTGGCGGCGGACTGGTGAAGCCTGGCGAG<br>TCCCTGAGGCTGTCCTGTGCCGCCTCCGGCTTCACCTTCTCCGACTAC<br>TACATGTACTGGGTCCGCCAGGCCCCTGGGAAGGGGCTGGAATGGGTG<br>GCCTCCATCTCCGACGGCGGCTCCAACACCTACTACTCCGACATCATC<br>AAGGGCCGGTTCACCATCTCCCGGGACAACGCCAAGAACAGCCTGTAC<br>CTGCAGATGAACTCCCTGAAGGCCGAGGACACCGCCGTGTACTACTGC<br>GCCCGGGGCTTCCCTCTGCTGAGACACGGCGCCTTCGATTACTGGGGC<br>CAGGGCACCCTGGTCACCGTCTCCTCAGGTGGTGGTGGTTCTGGCGGC<br>GGCGGCTCCGGTGGTGGTGGTTCTGACATCCAGATGACCCAGTCCCCC<br>AGCTCCCTGTCCGCCTCCGTGGGCGACAGAGTGACCATCACCTGCAGG<br>GCCTCCCAGAACGTGGACACCAACGTGGCCTGGTATCAGCAGAAGCCC<br>GGCCAGGCCCCTAAGTCCCTGATCTACTCCGCCACCTACCGGTACTCT<br>GACGTGCCTTCCCGGTTCTCCGGCTCCGCGTCCGGCACCGACTTCACC<br>CTGACCATCTCCAGCGTGCAGTCTGAGGACTTCGCCACGTACTACTGC<br>CAGCAGTACGACTCCTACCCTTACACCTTCGGCGGAGGGACCAAGCTG<br>GAAATCAAG |
| 349. | PM07F8L3 VH-VL x I2C VH-VL | artificial | aa | QVQLVESGGGLVKPGESLRLSCAASGFTFSDYYMYWVRQAPGKGLEWV<br>ASISDGGSNTYYSDIIKGRFTISRDNAKNSLYLQMNSLKAEDTAVYYC<br>ARGFPLLRHGAFDYWGQGTLVTVSSGGGGSGGGGSGGGGSDIQMTQSP<br>SSLSASVGDRVTITCRASQNVDTNVAWYQQKPGQAPKSLIYSATYRYS<br>DVPSRFSGSASGTDFTLTISSVQSEDFATYYCQQYDSYPYTFGGGTKL<br>EIKSGGGGSEVQLVESGGGLVQPGGSLKLSCAASGFTFNKYAMNWVRQ<br>APGKGLEWVARIRSKYNNYATYYADSVKDRFTISRDDSKNTAYLQMNN<br>LKTEDTAVYYCVRHGNFGNSYISYWAYWGQGTLVTVSSGGGGSGGGGS<br>GGGGSQTVVTQEPSLTVSPGGTVTLTCGSSTGAVTSGNYPNWVQQKPG<br>QAPRGLIGGTKFLAPGTPARFSGSLLGGKAALTLSGVQPEDEAEYYCV<br>LWYSNRWVFGGGTKLTVL |
| 350. | PM07F8L3 VH-VL x I2C VH-VL | artificial | nt | CAGGTGCAGCTGGTCGAGTCTGGCGGCGGACTGGTGAAGCCTGGCGAG<br>TCCCTGAGGCTGTCCTGTGCCGCCTCCGGCTTCACCTTCTCCGACTAC<br>TACATGTACTGGGTCCGCCAGGCCCCTGGGAAGGGGCTGGAATGGGTG<br>GCCTCCATCTCCGACGGCGGCTCCAACACCTACTACTCCGACATCATC<br>AAGGGCCGGTTCACCATCTCCCGGGACAACGCCAAGAACAGCCTGTAC<br>CTGCAGATGAACTCCCTGAAGGCCGAGGACACCGCCGTGTACTACTGC<br>GCCCGGGGCTTCCCTCTGCTGAGACACGGCGCCTTCGATTACTGGGGC |

| SEQ ID NO. | DESIGNATION | SOURCE | TYPE | SEQUENCE |
|---|---|---|---|---|
| | | | | CAGGGCACCCTGGTCACCGTCTCCTCAGGTGGTGGTGGTTCTGGCGGC<br>GGCGGCTCCGGTGGTGGTGGTTCTGACATCCAGATGACCCAGTCCCCC<br>AGCTCCCTGTCCGCCTCCGTGGGCGACAGAGTGACCATCACCTGCAGG<br>GCCTCCCAGAACGTGGACACCAACGTGGCCTGGTATCAGCAGAAGCCC<br>GGCCAGGCCCCTAAGTCCCTGATCTACTCCGCCACCTACCGGTACTCT<br>GACGTGCCTTCCCGGTTCTCCGGCTCCGCGTCCGGCACCGACTTCACC<br>CTGACCATCTCCAGCGTGCAGTCTGAGGACTTCGCCACGTACTACTGC<br>CAGCAGTACGACTCCTACCCTTACACCTTCGGCGGAGGGACCAAGCTG<br>GAAATCAAGTCCGGAGGTGGTGGATCCGAGGTGCAGCTGGTCGAGTCT<br>GGAGGAGGATTGGTGCAGCCTGGAGGGTCATTGAAACTCTCATGTGCA<br>GCCTCTGGATTCACCTTCAATAAGTACGCCATGAACTGGGTCCGCCAG<br>GCTCCAGGAAAGGGTTTGGAATGGGTTGCTCGCATAAGAAGTAAATAT<br>AATAATTATGCAACATATTATGCCGATTCAGTGAAAGACAGGTTCACC<br>ATCTCCAGAGATGATTCAAAAACACTGCCTATCTACAAATGAACAAC<br>TTGAAAACTGAGGACACTGCCGTGTACTACTGTGTGAGACATGGGAAC<br>TTCGGTAATAGCTACATATCCTACTGGGCTTACTGGGGCCAAGGGACT<br>CTGGTCACCGTCTCCTCAGGTGGTGGTGGTTCTGGCGGCGGCGGCTCC<br>GGTGGTGGTGGTTCTCAGACTGTTGTGACTCAGGAACCTTCACTCACC<br>GTATCACCTGGTGGAACAGTCACACTCACTTGTGGCTCCTCGACTGGG<br>GCTGTTACATCTGGCAACTACCCAAACTGGGTCCAACAAAAACCAGGT<br>CAGGCACCCCGTGGTCTAATAGGTGGGACTAAGTTCCTCGCCCCCGGT<br>ACTCCTGCCAGATTCTCAGGCTCCCTGCTTGGAGGCAAGGCTGCCCTC<br>ACCCTCTCAGGGGTACAGCCAGAGGATGAGGCAGAATATTACTGTGTT<br>CTATGGTACAGCAACCGCTGGGTGTTCGGTGGAGGAACCAAACTGACT<br>GTCCTA |
| 351. | PM07F8H3-VH | artificial | aa | QVQLVESGGGLVKPGESLRLSCAASGFTFSDYYMYWVRQAPGKGLEWV<br>ASISDGGSNTYYSDIIKGRFTISRDNAKNSLYLQMNSLKAEDTAVYYC<br>ARGFPLLRHGAMDYWGQGTLVTVSS |
| 352. | PM07F8H3-HCDR1 | artificial | aa | DYYMY |
| 353. | PM07F8H3-HCDR2 | artificial | aa | SISDGGSNTYYSDIIKG |
| 354. | PM07F8H3-HCDR3 | artificial | aa | GFPLLRHGAMDY |
| 355. | PM07F8H3-VH | artificial | nt | CAGGTGCAGCTGGTCGAGTCTGGCGGCGGACTGGTGAAGCCTGGCGAG<br>TCCCTGAGGCTGTCCTGTGCCGCCTCCGGCTTCACCTTCTCCGACTAC<br>TACATGTACTGGGTCCGCCAGGCCCCTGGGAAGGGGCTGGAATGGGTG<br>GCCTCCATCTCCGACGGCGGCTCCAACACCTACTACTCCGACATCATC<br>AAGGGCCGGTTCACCATCTCCCGGGACAACGCCAAGAACAGCCTGTAC<br>CTGCAGATGAACTCCCTGAAGGCCGAGGACACCGCCGTGTACTACTGC<br>GCCCGGGGCTTCCCTCTGCTGAGACACGGCGCCATGGATTACTGGGGC<br>CAGGGCACCCTGGTCACCGTCTCCTCA |
| 356. | PM07F8H3-VL | artificial | aa | DIQMTQSPSSLSASVGDRVTITCRASQNVDTNVAWYQQKPGQAPKSLI<br>YSATYRYSDVPSRFSGSASGTDFTLTISSVQSEDFATYYCQQYNSYPY<br>TFGGGTKLEIK |
| 357. | PM07F8H3-LCDR1 | artificial | aa | RASQNVDTNVA |
| 358. | PM07F8H3-LCDR2 | artificial | aa | SATYRYS |
| 359. | PM07F8H3-LCDR3 | artificial | aa | QQYNSYPYT |
| 360. | PM07F8H3-VL | artificial | nt | GACATCCAGATGACCCAGTCCCCCAGCTCCCTGTCCGCCTCCGTGGGC<br>GACAGAGTGACCATCACCTGCAGGGCCTCCCAGAACGTGGACACCAAC<br>GTGGCCTGGTATCAGCAGAAGCCCGGCCAGGCCCCTAAGTCCCTGATC<br>TACTCCGCCACCTACCGGTACTCTGACGTGCCTTCCCGGTTCTCCGGC<br>TCCGCGTCCGGCACCGACTTCACCCTGACCATCTCCAGCGTGCAGTCT<br>GAGGACTTCGCCACGTACTACTGCCAGCAGTACAACTCCTACCCTTAC<br>ACCTTCGGCGGAGGGACCAAGCTGGAAATCAAG |
| 361. | PM07F8H3-VH-VL | artificial | aa | QVQLVESGGGLVKPGESLRLSCAASGFTFSDYYMYWVRQAPGKGLEWV<br>ASISDGGSNTYYSDIIKGRFTISRDNAKNSLYLQMNSLKAEDTAVYYC<br>ARGFPLLRHGAMDYWGQGTLVTVSSGGGGSGGGGSGGGGSDIQMTQSP<br>SSLSASVGDRVTITCRASQNVDTNVAWYQQKPGQAPKSLIYSATYRYS<br>DVPSRFSGSASGTDFTLTISSVQSEDFATYYCQQYNSYPYTFGGGTKL<br>EIK |
| 362. | PM07F8H3-VH-VL | artificial | nt | CAGGTGCAGCTGGTCGAGTCTGGCGGCGGACTGGTGAAGCCTGGCGAG<br>TCCCTGAGGCTGTCCTGTGCCGCCTCCGGCTTCACCTTCTCCGACTAC<br>TACATGTACTGGGTCCGCCAGGCCCCTGGGAAGGGGCTGGAATGGGTG<br>GCCTCCATCTCCGACGGCGGCTCCAACACCTACTACTCCGACATCATC<br>AAGGGCCGGTTCACCATCTCCCGGGACAACGCCAAGAACAGCCTGTAC<br>CTGCAGATGAACTCCCTGAAGGCCGAGGACACCGCCGTGTACTACTGC<br>GCCCGGGGCTTCCCTCTGCTGAGACACGGCGCCATGGATTACTGGGGC |

| SEQ ID NO. | DESIGNATION | SOURCE | TYPE | SEQUENCE |
|---|---|---|---|---|
| | | | | CAGGGCACCCTGGTCACCGTCTCCTCAGGTGGTGGTGGTTCTGGCGGC<br>GGCGGCTCCGGTGGTGGTGGTTCTGACATCCAGATGACCCAGTCCCCC<br>AGCTCCCTGTCCGCCTCCGTGGGCGACAGAGTGACCATCACCTGCAGG<br>GCCTCCCAGAACGTGGACACCAACGTGGCCTGGTATCAGCAGAAGCCC<br>GGCCAGGCCCCTAAGTCCCTGATCTACTCCGCCACCTACCGGTACTCT<br>GACGTGCCTTCCCGGTTCTCCGGCTCCGCGTCCGGCACCGACTTCACC<br>CTGACCATCTCCAGCGTGCAGTCTGAGGACTTCGCCACGTACTACTGC<br>CAGCAGTACAACTCCTACCCTTACACCTTCGGCGGAGGGACCAAGCTG<br>GAAATCAAG |
| 363. | PM07F8H3 VH-VL × I2C<br>VH-VL | artificial | aa | QVQLVESGGGLVKPGESLRLSCAASGFTFSDYYMYWVRQAPGKGLEWV<br>ASISDGGSNTYYSDIIKGRFTISRDNAKNSLYLQMNSLKAEDTAVYYC<br>ARGFPLLRHGAMDYWGQGTLVTVSSGGGGSGGGGSGGGGSDIQMTQSP<br>SSLSASVGDRVTITCRASQNVDTNVAWYQQKPGQAPKSLIYSATYRYS<br>DVPSRFSGSASGTDFTLTISSVQSEDFATYYCQQYNSYPYTFGGGTKL<br>EIKSGGGGSEVQLVESGGGLVQPGGSLKLSCAASGFTFNKYAMNWVRQ<br>APGKGLEWVARIRSKYNNYATYYADSVKDRFTISRDDSKNTAYLQMNN<br>LKTEDTAVYYCVRHGNFGNSYISYWAYWGQGTLVTVSSGGGGSGGGGS<br>GGGGSQTVVTQEPSLTVSPGGTVTLTCGSSTGAVTSGNYPNWVQQKPG<br>QAPRGLIGGTKFLAPGTPARFSGSLLGGKAALTLSGVQPEDEAEYYCV<br>LWYSNRWVFGGGTKLTVL |
| 364. | PM07F8H3 VH-VL × I2C<br>VH-VL | artificial | nt | CAGGTGCAGCTGGTCGAGTCTGGCGGCGGACTGGTGAAGCCTGGCGAG<br>TCCCTGAGGCTGTCCTGTGCCGCCTCCGGCTTCACCTTCTCCGACTAC<br>TACATGTACTGGGTCCGCCAGGCCCCTGGGAAGGGGCTGGAATGGGTG<br>GCCTCCATCTCCGACGGCGGCTCCAACACCTACTACTCCGACATCATC<br>AAGGGCCGGTTCACCATCTCCCGGGACAACGCCAAGAACAGCCTGTAC<br>CTGCAGATGAACTCCCTGAAGGCCGAGGACACCGCCGTGTACTACTGC<br>GCCCGGGGCTTCCCTCTGCTGAGACACGGCGCCATGGATTACTGGGGC<br>CAGGGCACCCTGGTCACCGTCTCCTCAGGTGGTGGTGGTTCTGGCGGC<br>GGCGGCTCCGGTGGTGGTGGTTCTGACATCCAGATGACCCAGTCCCCC<br>AGCTCCCTGTCCGCCTCCGTGGGCGACAGAGTGACCATCACCTGCAGG<br>GCCTCCCAGAACGTGGACACCAACGTGGCCTGGTATCAGCAGAAGCCC<br>GGCCAGGCCCCTAAGTCCCTGATCTACTCCGCCACCTACCGGTACTCT<br>GACGTGCCTTCCCGGTTCTCCGGCTCCGCGTCCGGCACCGACTTCACC<br>CTGACCATCTCCAGCGTGCAGTCTGAGGACTTCGCCACGTACTACTGC<br>CAGCAGTACAACTCCTACCCTTACACCTTCGGCGGAGGGACCAAGCTG<br>GAAATCAAGTCCGGAGGTGGTGGATCGAGGTGCAGCTGGTCGAGTCT<br>GGAGGAGGATTGGTGCAGCCTGGAGGGTCATTGAAACTCTCATGTGCA<br>GCCTCTGGATTCACCTTCAATAAGTACGCCATGAACTGGGTCCGCCAG<br>GCTCCAGGAAAAGGGTTTGGAATGGGTTGCTCGCATAAGAAGTAAATAT<br>AATAATTATGCAACATATTATGCCGATTCAGTGAAAGACAGGTTCACC<br>ATCTCCAGAGATGATTCAAAAAACACTGCCTATCTACAAATGAACAAC<br>TTGAAAACTGAGGACACTGCCGTGTACTACTGTGTGAGACATGGGAAC<br>TTCGGTAATAGCTACATATCCTACTGGGCTTACTGGGGCCAAGGGACT<br>CTGGTCACCGTCTCCTCAGGTGGTGGTGGTTCTGGCGGCGGCGGCTCC<br>GGTGGTGGTGGTTCTCAGACTGTTGTGACTCAGGAACCTTCACTCACC<br>GTATCACCTGGTGGAACAGTCACACTCACTTGTGGCTCCTCGACTGGG<br>GCTGTTACATCTGGCAACTACCCAAACTGGGTCCAACAAAAACCAGGT<br>CAGGCACCCCGTGGTCTAATAGGTGGGACTAAGTTCCTCGCCCCCGGT<br>ACTCCTGCCAGATTCTCAGGCTCCCTGCTTGGAGGCAAGGCTGCCCTC<br>ACCCTCTCAGGGGTACAGCCAGAGGATGAGGCAGAATATTACTGTGTT<br>CTATGGTACAGCAACCGCTGGGTGTTCGGTGGAGGAACCAAACTGACT<br>GTCCT |
| 365. | PM07F8H2-VH | artificial | aa | QVQLVESGGGLVKPGESLRLSCAASGFTFSDYYMYWVRQAPGKGLEWV<br>AIISDGGYYTYYSDIIKGRFTISRDNAKNSLYLQMNSLKAEDTAVYYC<br>ARGFPLLRHGAFDYWGQGTLVTVSS |
| 366. | PM07F8H2-HCDR1 | artificial | aa | DYYMY |
| 367. | PM07F8H2-HCDR2 | artificial | aa | IISDGGYYTYYSDIIKG |
| 368. | PM07F8H2-HCDR3 | artificial | aa | GFPLLRHGAFDY |
| 369. | PM07F8H2-VH | artificial | nt | CAGGTGCAGCTGGTCGAGTCTGGCGGCGGACTGGTGAAGCCTGGCGAG<br>TCCCTGAGGCTGTCCTGTGCCGCCTCCGGCTTCACCTTCTCCGACTAC<br>TACATGTACTGGGTCCGCCAGGCCCCTGGGAAGGGGCTGGAATGGGTG<br>GCCATCATCTCCGACGGCGGCTACTACACCTACTACTCCGACATCATC<br>AAGGGCCGGTTCACCATCTCCCGGGACAACGCCAAGAACAGCCTGTAC<br>CTGCAGATGAACTCCCTGAAGGCCGAGGACACCGCCGTGTACTACTGC<br>GCCCGGGGCTTCCCTCTGCTGAGACACGGCGCCTTCGATTACTGGGGC<br>CAGGGCACCCTGGTCACCGTCTCCTCA |
| 370. | PM07F8H2-VL | artificial | aa | DIQMTQSPSSLSASVGDRVTITCRASQNVDTNVAWYQQKPGQAPKSLI<br>YSATYRYSDVPSRFSGSASGTDFTLTISSVQSEDFATYYCQQYNSYPY<br>TFGGGTKLEIK |

| SEQ ID NO. | DESIGNATION | SOURCE | TYPE | SEQUENCE |
|---|---|---|---|---|
| 371. | PM07F8H2-LCDR1 | artificial | aa | RASQNVDTNVA |
| 372. | PM07F8H2-LCDR2 | artificial | aa | SATYRS |
| 373. | PM07F8H2-LCDR3 | artificial | aa | QQYNSYPYT |
| 374. | PM07F8H2-VL | artificial | nt | GACATCCAGATGACCCAGTCCCCCAGCTCCCTGTCCGCCTCCGTGGGC GACAGAGTGACCATCACCTGCAGGGCCTCCCAGAACGTGGACACCAAC GTGGCCTGGTATCAGCAGAAGCCCGGCCAGGCCCCTAAGTCCCTGATC TACTCCGCCACCTACCGGTACTCTGACGTGCCTTCCCGGTTCTCCGGC TCCGCGTCCGGCACCGACTTCACCCTGACCATCTCCAGCGTGCAGTCT GAGGACTTCGCCACGTACTACTGCCAGCAGTACAACTCCTACCCTTAC ACCTTCGGCGGAGGGACCAAGCTGGAAATCAAG |
| 375. | PM07F8H2-VH-VL | artificial | aa | QVQLVESGGGLVKPGESLRLSCAASGFTFSDYYMYWVRQAPGKGLEWV AIISDGGYYTYYSDIIKGRFTISRDNAKNSLYLQMNSLKAEDTAVYYC ARGFPLLRHGAFDYWGQGTLVTVSSGGGGSGGGGSGGGGSDIQMTQSP SSLSASVGDRVTITCRASQNVDTNVAWYQQKPGQAPKSLIYSATYRS DVPSRFSGSASGTDFTLTISSVQSEDFATYYCQQYNSYPYTFGGGTKL EIK |
| 376. | PM07F8H2-VH-VL | artificial | nt | CAGGTGCAGCTGGTCGAGTCTGGCGGCGGACTGGTGAAGCCTGGCGAG TCCCTGAGGCTGTCCTGTGCCGCCTCCGGCTTCACCTTCTCCGACTAC TACATGTACTGGGTCCGCCAGGCCCCTGGGAAGGGGCTGGAATGGGTG GCCATCATCTCCGACGGCGGCTACTACACCTACTACTCCGACATCATC AAGGGCCGGTTCACCATCTCCCGGGACAACGCCAAGAACAGCCTGTAC CTGCAGATGAACTCCCTGAAGGCCGAGGACACCGCCGTGTACTACTGC GCCCGGGGCTTCCCTCTGCTGAGACACGGCGCCTTCGATTACTGGGGC CAGGGCACCCTGGTCACCGTCTCCTCAGGTGGTGGTGGTTCTGGCGGC GGCGGCTCCGGTGGTGGTGGTTCTGACATCCAGATGACCCAGTCCCCC AGCTCCCTGTCCGCCTCCGTGGGCGACAGAGTGACCATCACCTGCAGG GCCTCCCAGAACGTGGACACCAACGTGGCCTGGTATCAGCAGAAGCCC GGCCAGGCCCCTAAGTCCCTGATCTACTCCGCCACCTACCGGTACTCT GACGTGCCTTCCCGGTTCTCCGGCTCCGCGTCCGGCACCGACTTCACC CTGACCATCTCCAGCGTGCAGTCTGAGGACTTCGCCACGTACTACTGC CAGCAGTACAACTCCTACCCTTACACCTTCGGCGGAGGGACCAAGCTG GAAATCAAG |
| 377. | PM07F8H2 VH-VL x I2C VH-VL | artificial | aa | QVQLVESGGGLVKPGESLRLSCAASGFTFSDYYMYWVRQAPGKGLEWV AIISDGGYYTYYSDIIKGRFTISRDNAKNSLYLQMNSLKAEDTAVYYC ARGFPLLRHGAFDYWGQGTLVTVSSGGGGSGGGGSGGGGSDIQMTQSP SSLSASVGDRVTITCRASQNVDTNVAWYQQKPGQAPKSLIYSATYRS DVPSRFSGSASGTDFTLTISSVQSEDFATYYCQQYNSYPYTFGGGTKL EIKSGGGGSEVQLVESGGGLVQPGGSLKLSCAASGFTFNKYAMNWVRQ APGKGLEWVARIRSKYNNYATYYADSVKDRFTISRDDSKNTAYLQMNN LKTEDTAVYYCVRHGNFGNSYISYWAYWGQGTLVTVSSGGGGSGGGGS GGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCV LWYSNRWVFGGGTKLTVL |
| 378. | PM07F8H2 VH-VL x I2C VH-VL | artificial | nt | CAGGTGCAGCTGGTCGAGTCTGGCGGCGGACTGGTGAAGCCTGGCGAG TCCCTGAGGCTGTCCTGTGCCGCCTCCGGCTTCACCTTCTCCGACTAC TACATGTACTGGGTCCGCCAGGCCCCTGGGAAGGGGCTGGAATGGGTG GCCATCATCTCCGACGGCGGCTACTACACCTACTACTCCGACATCATC AAGGGCCGGTTCACCATCTCCCGGGACAACGCCAAGAACAGCCTGTAC CTGCAGATGAACTCCCTGAAGGCCGAGGACACCGCCGTGTACTACTGC GCCCGGGGCTTCCCTCTGCTGAGACACGGCGCCTTCGATTACTGGGGC CAGGGCACCCTGGTCACCGTCTCCTCAGGTGGTGGTGGTTCTGGCGGC GGCGGCTCCGGTGGTGGTGGTTCTGACATCCAGATGACCCAGTCCCCC AGCTCCCTGTCCGCCTCCGTGGGCGACAGAGTGACCATCACCTGCAGG GCCTCCCAGAACGTGGACACCAACGTGGCCTGGTATCAGCAGAAGCCC GGCCAGGCCCCTAAGTCCCTGATCTACTCCGCCACCTACCGGTACTCT GACGTGCCTTCCCGGTTCTCCGGCTCCGCGTCCGGCACCGACTTCACC CTGACCATCTCCAGCGTGCAGTCTGAGGACTTCGCCACGTACTACTGC CAGCAGTACAACTCCTACCCTTACACCTTCGGCGGAGGGACCAAGCTG GAAATCAAGTCGGAGGTGTGGATCCAGGTGCAGCTGGTCGAGTCT GGAGGAGGATTGGTGCAGCCTGGAGGGTCATTGAAACTCTCATGTGCA GCCTCTGGATTCACCTTCAATAAGTACGCCATGAACTGGGTCCGCCAG GCTCCAGGAAAGGGTTTGGAATGGGTTGCTCGCATAAGAAGTAAATAT AATAATTATGCAACATATTATGCCGATTCAGTGAAAGACAGGTTCACC ATCTCCAGAGATGATTCAAAAACACTGCCTATCTACAAATGAACAAC TTGAAACTGAGGACACTGCCGTGTACTACTGTGTGAGACATGGGAAC TTCGGTAATAGCTACATATCCTACTGGGCTTACTGGGGCCAAGGGACT CTGGTCACCGTCTCCTCAGGTGGTGGTGGTTCTGGCGGCGGCGGCTCC GGTGGTGGTGGTTCTCAGACTGTTGTGACTCAGGAACCTTCACTCACC GTATCACCTGGTGGAACAGTCACACTCACTTGTGGCTCCTCGACTGGG
|

| SEQ ID NO. | DESIGNATION | SOURCE | TYPE | SEQUENCE |
|---|---|---|---|---|
| | | | | GCTGTTACATCTGGCAACTACCCAAACTGGGTCCAACAAAAACCAGGT<br>CAGGCACCCCGTGGTCTAATAGGTGGGACTAAGTTCCTCGCCCCCGGT<br>ACTCCTGCCAGATTCTCAGGCTCCCTGCTTGGAGGCAAGGCTGCCCTC<br>ACCCTCTCAGGGGTACAGCCAGAGGATGAGGCAGAATATTACTGTGTT<br>CTATGGTACAGCAACCGCTGGGTGTTCGGTGGAGGAACCAAACTGACT<br>GTCCTA |
| 379. | PMH5A5-VH | artificial | aa | QVQLVQSGAEVKKPGASVKVSCKASGYNFKDTYMDWVKQTPEQGLEWM<br>GRIDPANGDSKYDPKFQGRVTITADTSTNTAYMELSSLRSEDTAVYYC<br>ARGGMIWYFDVWGQGTTVTVSS |
| 380. | PMH5A5-HCDR1 | artificial | aa | DTYMD |
| 381. | PMH5A5-HCDR2 | artificial | aa | RIDPANGDSKYDPKFQG |
| 382. | PMH5A5-HCDR3 | artificial | aa | GGMIWYFDV |
| 383. | PMH5A5-VH | artificial | nt | CAGGTGCAGCTGGTCCAGTCTGGGGCAGAGGTTAAGAAGCCAGGGGCC<br>TCAGTCAAGGTGTCCTGCAAAGCTTCTGGCTACAACTTTAAAGACACC<br>TATATGGACTGGGTGAAGCAGACGCCTGAACAGGGCCTGGAATGGATG<br>GGAAGGATTGATCCTGCGAATGGTGATAGTAAATATGACCCGAAATTC<br>CAGGGCAGGGTCACTATAACAGCAGACACATCCACCAACACAGCCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCA |
| 384. | PMH5A5-VL | artificial | aa | EIVLTQSPATLSLSPGEKATLSCSASSSISSNYLHWYQQKPGLPPRLL<br>IYRTSNLASGIPDRFSGSGSGTDYTLTISRLEPEDVATYYCQQGSSLP<br>YTFGQGTKLEIK |
| 385. | PMH5A5-LCDR1 | artificial | aa | SASSSISSNYLH |
| 386. | PMH5A5-LCDR2 | artificial | aa | RTSNLAS |
| 387. | PMH5A5-LCDR3 | artificial | aa | QQGSSLPYT |
| 388. | PMH5A5-VL | artificial | nt | GAGATCGTGCTCACCCAGTCTCCAGCCACCCTGTCTCTATCTCCCGGG<br>GAGAAGGCCACTCTCTCCTGCAGTGCCAGCTCAAGTATAAGTTCCAAT<br>TACTTGCATTGGTATCAGCAGAAGCCAGGATTGCCCCCTAGACTCTTG<br>ATTTATAGGACATCCAATCTGGCTTCTGGAATCCCAGATCGCTTCAGT<br>GGCAGTGGGTCTGGGACCGATTACACTCTCACAATTAGCAGGCTGGAG<br>CCTGAAGATGTTGCCACTTACTACTGCCAGCAGGGTAGTAGTTTACCG<br>TACACGTTCGGACAAGGGACCAAGCTTGAGATCAAA |
| 389. | PMH5A5-VH-VL | artificial | aa | QVQLVQSGAEVKKPGASVKVSCKASGYNFKDTYMDWVKQTPEQGLEWM<br>GRIDPANGDSKYDPKFQGRVTITADTSTNTAYMELSSLRSEDTAVYYC<br>ARGGMIWYFDVWGQGTTVTVSSGGGGSGGGGSGGGGSEIVLTQSPATL<br>SLSPGEKATLSCSASSSISSNYLHWYQQKPGLPPRLLIYRTSNLASGI<br>PDRFSGSGSGTDYTLTISRLEPEDVATYYCQQGSSLPYTFGQGTKLEI<br>K |
| 390. | PMH5A5-VH-VL | artificial | nt | CAGGTGCAGCTGGTCCAGTCTGGGGCAGAGGTTAAGAAGCCAGGGGCC<br>TCAGTCAAGGTGTCCTGCAAAGCTTCTGGCTACAACTTTAAAGACACC<br>TATATGGACTGGGTGAAGCAGACGCCTGAACAGGGCCTGGAATGGATG<br>GGAAGGATTGATCCTGCGAATGGTGATAGTAAATATGACCCGAAATTC<br>CAGGGCAGGGTCACTATAACAGCAGACACATCCACCAACACAGCCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCAGGTGGTGGTGGTTCTGGCGGCGGCGGCTCC<br>GGTGGTGGTGGTTCTGAGATCGTGCTCACCCAGTCTCCAGCCACCCTG<br>TCTCTATCTCCCGGGGAGAAGGCCACTCTCTCCTGCAGTGCCAGCTCA<br>AGTATAAGTTCCAATTACTTGCATTGGTATCAGCAGAAGCCAGGATTG<br>CCCCCTAGACTCTTGATTTATAGGACATCCAATCTGGCTTCTGGAATC<br>CCAGATCGCTTCAGTGGCAGTGGGTCTGGGACCGATTACACTCTCACA<br>ATTAGCAGGCTGGAGCCTGAAGATGTTGCCACTTACTACTGCCAGCAG<br>GGTAGTAGTTTACCGTACACGTTCGGACAAGGGACCAAGCTTGAGATC<br>AAA |
| 391. | PMH5A5 VH-VL × I2C VH-VL | artificial | aa | QVQLVQSGAEVKKPGASVKVSCKASGYNFKDTYMDWVKQTPEQGLEWM<br>GRIDPANGDSKYDPKFQGRVTITADTSTNTAYMELSSLRSEDTAVYYC<br>ARGGMIWYFDVWGQGTTVTVSSGGGGSGGGGSGGGGSEIVLTQSPATL<br>SLSPGEKATLSCSASSSISSNYLHWYQQKPGLPPRLLIYRTSNLASGI<br>PDRFSGSGSGTDYTLTISRLEPEDVATYYCQQGSSLPYTFGQGTKLEI<br>KKSGGGGSEVQLVESGGGLVQPGGSLKLSCAASGFTFNKYAMNWVRQA<br>PGKGLEWVARIRSKYNNYATYYADSVKDRFTISRDDSKNTAYLQMNNL<br>KTEDTAVYYCVRHGNFGNSYISYWAYWGQGTLVTVSSGGGGSGGGGSG<br>GGGSQTVVTQEPSLTVSPGGTVTLTCGSSTGAVTSGNYPNWVQQKPGQ |

| SEQ ID NO. | DESIGNATION | SOURCE | TYPE | SEQUENCE |
|---|---|---|---|---|
| | | | | APRGLIGGTKFLAPGTPARFSGSLLGGKAALTLSGVQPEDEAEYYCVL WYSNRWVFGGGTKLTVL |
| 392. | PMH5A5 VH-VL x I2C VH-VL | artificial | nt | CAGGTGCAGCTGGTCCAGTCTGGGGCAGAGGTTAAGAAGCCAGGGGCC TCAGTCAAGGTGTCCTGCAAAGCTTCTGGCTACAACTTTAAAGACACC TATATGGACTGGGTGAAGCAGACGCCTGAACAGGGCCTGGAATGGATG GGAAGGATTGATCCTGCAATGGTGATAGTAAATATGACCCGAAATTC CAGGGCAGGGTCACTATAACAGCAGACACATCCACCAACACAGCCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCCTG TCTCTATCTCCCGGGGAGAAGGCCACTCTCTCCTGCAGTGCCAGCTCA AGTATAAGTTCCAATTACTTGCATTGGTATCAGCAGAAGCCAGGATTG CCCCCTAGACTCTTGATTTATAGGACATCCAATCTGGCTTCTGGAATC CCAGATCGCTTCAGTGGCAGTGGGTCTGGGACCGATTACACTCTCACA ATTAGCAGGCTGGAGCCTGAAGATGTTGCCACTTACTACTGCCAGCAG GGTAGTAGTTTACCGTACACGTTCGGACAAGGGACCAAGCTTGAGATC AAATCCGGAGGTGGTGGATCCGAGGTGCAGCTGGTCGAGTCTGGAGGA GGATTGGTGCAGCCTGGAGGGTCATTGAAACTCTCATGTGCAGCCTCT GGATTCACCTTCAATAAGTACGCCATGAACTGGGTCCGCCAGGCTCCA GGAAAGGGTTTGGAATGGGTTGCTCGCATAAGAAGTAAATATAATAAT TATGCAACATATTATGCCGATTCAGTGAAAGACAGGTTCACCATCTCC AGAGATGATTCAAAAAACACTGCCTATCTACAAATGAACAACTTGAAA ACTGAGGACACTGCCGTGTACTACTGTGTGAGACATGGGAACTTCGGT AATAGCTACATATCCTACTGGGCTTACTGGGGCCAAGGGACTCTGGTC ACCGTCTCCTCAGGTGGTGGTGGTTCTGGCGGCGGCGGCTCCGGTGGT GGTGGTTCTCAGACTGTTGTGACTCAGGAACCTTCACTCACCGTATCA CCTGGTGGAACAGTCACACTCACTTGTGGCTCCTCGACTGGGGCTGTT ACATCTGGCAACTACCCAAACTGGGTCCAACAAAAACCAGGTCAGGCA CCCCGTGGTCTAATAGGTGGGACTAAGTTCCTCGCCCCGGTACTCCT GCCAGATTCTCAGGCTCCCTGCTTGGAGGCAAGGCTGCCCTCACCCTC TCAGGGGTACAGCCAGAGGATGAGGCAGAATATTACTGTGTTCTATGG TACAGCAACCGCTGGGTGTTCGGTGGAGGAACCAAACTGACTGTCCTA |
| 393. | PMH8A5-VH | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSS |
| 394. | PMH8A5-HCDR1 | artificial | aa | DTYMD |
| 395. | PMH8A5-HCDR2 | artificial | aa | RIDPANGDSKYDPKFQG |
| 396. | PMH8A5-HCDR3 | artificial | aa | GGMIWYFDV |
| 397. | PMH8A5-VH | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCA |
| 398. | PMH8A5-VL | artificial | aa | EIVLTQSPATLSLSPGEKATLSCSASSSISSNYLHWYQQKPGLPPRLL IYRTSNLASGIPDRFSGSGSGTDYTLTISRLEPEDVATYYCQQGSSLP YTFGQGTKLEIK |
| 399. | PMH8A5-LCDR1 | artificial | aa | SASSSISSNYLH |
| 400. | PMH8A5-LCDR2 | artificial | aa | RTSNLAS |
| 401. | PMH8A5-LCDR3 | artificial | aa | QQGSSLPYT |
| 402. | PMH8A5-VL | artificial | nt | GAGATCGTGCTCACCCAGTCTCCAGCCACCCTGTCTCTATCTCCCGGG GAGAAGGCCACTCTCTCCTGCAGTGCCAGCTCAAGTATAAGTTCCAAT TACTTGCATTGGTATCAGCAGAAGCCAGGATTGCCCCCTAGACTCTTG ATTTATAGGACATCCAATCTGGCTTCTGGAATCCCAGATCGCTTCAGT GGCAGTGGGTCTGGGACCGATTACACTCTCACAATTAGCAGGCTGGAG CCTGAAGATGTTGCCACTTACTACTGCCAGCAGGGTAGTAGTTTACCG TACACGTTCGGACAAGGGACCAAGCTTGAGATCAAA |
| 403. | PMH8A5-VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATL |

| SEQ ID NO. | DESIGNATION | SOURCE | TYPE | SEQUENCE |
|---|---|---|---|---|
| | | | | SLSPGEKATLSCSASSSISSNYLHWYQQKPGLPPRLLIYRTSNLASGI PDRFSGSGSGTDYTLTISRLEPEDVATYYCQQGSSLPYTFGQGTKLEI K |
| 404. | PMH8A5-VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCCTG TCTCTATCTCCCGGGGAGAAGGCCACTCTCTCCTGCAGTGCCAGCTCA AGTATAAGTTCCAATTACTTGCATTGGTATCAGCAGAAGCCAGGATTG CCCCCTAGACTCTTGATTTATAGGACATCCAATCTGGCTTCTGGAATC CCAGATCGCTTCAGTGGCAGTGGGTCTGGGACCGATTACACTCTCACA ATTAGCAGGCTGGAGCCTGAAGATGTTGCCACTTACTACTGCCAGCAG GGTAGTAGTTTACCGTACACGTTCGGACAAGGGACCAAGCTTGAGATC AAA |
| 405. | PMH8A5 VH-VL × I2C VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATL SLSPGEKATLSCSASSSISSNYLHWYQQKPGLPPRLLIYRTSNLASGI PDRFSGSGSGTDYTLTISRLEPEDVATYYCQQGSSLPYTFGQGTKLEI KKSGGGGSEVQLVESGGGLVQPGGSLKLSCAASGFTFNKYAMNWVRQA PGKGLEWVARIRSKYNNYATYYADSVKDRFTISRDDSKNTAYLQMNNL KTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQ APRGLIGGTKFLAPGTPARFSGSLLGGKAALTLSGVQPEDEAEYYCVL WYSNRWVFGGGTKLTVL |
| 406. | PMH8A5 VH-VL × I2C VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCCTG TCTCTATCTCCCGGGGAGAAGGCCACTCTCTCCTGCAGTGCCAGCTCA AGTATAAGTTCCAATTACTTGCATTGGTATCAGCAGAAGCCAGGATTG CCCCCTAGACTCTTGATTTATAGGACATCCAATCTGGCTTCTGGAATC CCAGATCGCTTCAGTGGCAGTGGGTCTGGGACCGATTACACTCTCACA ATTAGCAGGCTGGAGCCTGAAGATGTTGCCACTTACTACTGCCAGCAG GGTAGTAGTTTACCGTACACGTTCGGACAAGGGACCAAGCTTGAGATC AAATCCGGAGGTGGTGGATCCGAGGTGCAGCTGGTCGAGTCTGGAGGA GGATTGGTGCAGCCTGGAGGGTCATTGAAACTCTCATGTGCAGCCTCT GGATTCACCTTCAATAAGTACGCCATGAACTGGGTCCGCCAGGCTCCA GGAAAGGGTTTGGAATGGGTTGCTCGCATAAGAAGTAAATATAATAAT TATGCAACATATTATGCCGATTCAGTGAAAGACAGGTTCACCATCTCC AGAGATGATTCAAAAAACACTGCCTATCTACAAATGAACAACTTGAAA ACTGAGGACACTGCCGTGTACTACTGTGTGAGACATGGGAACTTCGGT AATAGCTACATATCCTACTGGGCTTACTGGGGCCAAGGGACTCTGGTC ACCGTCTCCTCAGGTGGTGGTGGTTCTGGCGGCGGCGGCTCCGGTGGT GGTGGTTCTCAGACTGTTGTGACTCAGGAACCTTCACTCACCGTATCA CCTGGTGGAACAGTCACACTCACTTGTGGCTCCTCGACTGGGGCTGTT ACATCTGGCAACTACCCAAACTGGGTCCAACAAAAACCAGGTCAGGCA CCCCGTGGTCTTATAGGTGGGACTAAGTTCCTCGCCCCCGGTACTCCT GCCAGATTCTCAGGCTCCCTGCTTGGAGGCAAGGCTGCCCTCACCCTC TCAGGGGTACAGCCAGAGGATGAGGCAGAATATTACTGTGTTCTATGG TACAGCAACCGCTGGGTGTTCGGTGGAGGAACCAAACTGACTGTCCT |
| 407. | PMH5B1-VH | artificial | aa | QVQLVQSGAEVKKPGASVKVSCKASGYNFKDTYMDWVKQTPEQGLEWM GRIDPANGDSKYDPKFQGRVTITADTSTNTAYMELSSLRSEDTAVYYC ARGGMIWYFDVWGQGTTVTVSS |
| 408. | PMH5B1-HCDR1 | artificial | aa | DTYMD |
| 409. | PMH5B1-HCDR2 | artificial | aa | RIDPANGDSKYDPKFQG |
| 410. | PMH5B1-HCDR3 | artificial | aa | GGMIWYFDV |
| 411. | PMH5B1-VH | artificial | nt | CAGGTGCAGCTGGTCCAGTCTGGGGCAGAGGTTAAGAAGCCAGGGGCC TCAGTCAAGGTGTCCTGCAAAGCTTCTGGCTACAACTTTAAAGACACC |

| SEQ ID NO. | DESIGNATION | SOURCE | TYPE | SEQUENCE |
|---|---|---|---|---|
| | | | | TATATGGACTGGGTGAAGCAGACGCCTGAACAGGGCCTGGAATGGATG<br>GGAAGGATTGATCCTGCGAATGGTGATAGTAAATATGACCCGAAATTC<br>CAGGGCAGGGTCACTATAACAGCAGACACATCCACCAACACAGCCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCA |
| 412. | PMH5B1-VL | artificial | aa | EIVLTQSPATLSLSPGERATLSCSASSSISSNYLHWYQQKPGLPPRLL<br>IYRTSNLASGIPDRFSGSGSGTDFTLTISRMEAEDFAVYYCQQGSSLP<br>YTFGQGTKLEIK |
| 413. | PMH5B1-LCDR1 | artificial | aa | SASSSISSNYLH |
| 414. | PMH5B1-LCDR2 | artificial | aa | RTSNLAS |
| 415. | PMH5B1-LCDR3 | artificial | aa | QQGSSLPYT |
| 416. | PMH5B1-VL | artificial | nt | GAGATCGTGCTCACCCAGTCTCCAGCCACCCTGTCTCTATCTCCCGGG<br>GAGAGGGCCACTCTCTCCTGCAGTGCCAGCTCAAGTATAAGTTCCAAT<br>TACTTGCATTGGTATCAGCAGAAGCCAGGATTGCCCCCTAGACTCTTG<br>ATTTATAGGACATCCAATCTGGCTTCTGGAATCCCAGATCGCTTCAGT<br>GGCAGTGGGTCTGGGACCGATTTCACTCTCACAATTAGCAGGATGGAG<br>GCTGAAGATTTTGCCGTTTACTACTGCCAGCAGGGTAGTAGTTTACCG<br>TACACGTTCGGACAAGGGACCAAGCTTGAGATCAAA |
| 417. | PMH5B1-VH-VL | artificial | aa | QVQLVQSGAEVKKPGASVKVSCKASGYNFKDTYMDWVKQTPEQGLEWM<br>GRIDPANGDSKYDPKFQGRVTITADTSTNTAYMELSSLRSEDTAVYYC<br>ARGGMIWYFDVWGQGTTVTVSSGGGGSGGGGSGGGGSEIVLTQSPATL<br>SLSPGERATLSCSASSSISSNYLHWYQQKPGLPPRLLIYRTSNLASGI<br>PDRFSGSGSGTDFTLTISRMEAEDFAVYYCQQGSSLPYTFGQGTKLEI<br>K |
| 418. | PMH5B1-VH-VL | artificial | nt | CAGGTGCAGCTGGTCCAGTCTGGGGCAGAGGTTAAGAAGCCAGGGGCC<br>TCAGTCAAGGTGTCCTGCAAAGCTTCTGGCTACAACTTTAAAGACACC<br>TATATGGACTGGGTGAAGCAGACGCCTGAACAGGGCCTGGAATGGATG<br>GGAAGGATTGATCCTGCGAATGGTGATAGTAAATATGACCCGAAATTC<br>CAGGGCAGGGTCACTATAACAGCAGACACATCCACCAACACAGCCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCAGGTGGTGGTGGTTCTGGCGGCGGCGGCTCC<br>GGTGGTGGTGGTTCTGAGATCGTGCTCACCCAGTCTCCAGCCACCCTG<br>TCTCTATCTCCCGGGGAGAGGGCCACTCTCTCCTGCAGTGCCAGCTCA<br>AGTATAAGTTCCAATTACTTGCATTGGTATCAGCAGAAGCCAGGATTG<br>CCCCCTAGACTCTTGATTTATAGGACATCCAATCTGGCTTCTGGAATC<br>CCAGATCGCTTCAGTGGCAGTGGGTCTGGGACCGATTTCACTCTCACA<br>ATTAGCAGGATGGAGGCTGAAGATTTTGCCGTTTACTACTGCCAGCAG<br>GGTAGTAGTTTACCGTACACGTTCGGACAAGGGACCAAGCTTGAGATC<br>AAA |
| 419. | PMH5B1 VH-VL x I2C VH-VL | artificial | aa | QVQLVQSGAEVKKPGASVKVSCKASGYNFKDTYMDWVKQTPEQGLEWM<br>GRIDPANGDSKYDPKFQGRVTITADTSTNTAYMELSSLRSEDTAVYYC<br>ARGGMIWYFDVWGQGTTVTVSSGGGGSGGGGSGGGGSEIVLTQSPATL<br>SLSPGERATLSCSASSSISSNYLHWYQQKPGLPPRLLIYRTSNLASGI<br>PDRFSGSGSGTDFTLTISRMEAEDFAVYYCQQGSSLPYTFGQGTKLEI<br>KSGGGGSEVQLVESGGGLVQPGGSLKLSCAASGFTFNKYAMNWVRQAP<br>GKGLEWVARIRSKYNNYATYYADSVKDRFTISRDDSKNTAYLQMNNLK<br>TEDTAVYYCVRHGNFGNSYISYWAYWGQGTLVTVSSGGGGSGGGGSGG<br>GGSQTVVTQEPSLTVSPGGTVTLTCGSSTGAVTSGNYPNWVQQKPGQA<br>PRGLIGGTKFLAPGTPARFSGSLLGGKAALTLSGVQPEDEAEYYCVLW<br>YSNRWVFGGGTKLTVL |
| 420. | PMH5B1 VH-VL x I2C VH-VL | artificial | nt | CAGGTGCAGCTGGTCCAGTCTGGGGCAGAGGTTAAGAAGCCAGGGGCC<br>TCAGTCAAGGTGTCCTGCAAAGCTTCTGGCTACAACTTTAAAGACACC<br>TATATGGACTGGGTGAAGCAGACGCCTGAACAGGGCCTGGAATGGATG<br>GGAAGGATTGATCCTGCGAATGGTGATAGTAAATATGACCCGAAATTC<br>CAGGGCAGGGTCACTATAACAGCAGACACATCCACCAACACAGCCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCAGGTGGTGGTGGTTCTGGCGGCGGCGGCTCC<br>GGTGGTGGTGGTTCTGAGATCGTGCTCACCCAGTCTCCAGCCACCCTG<br>TCTCTATCTCCCGGGGAGAGGGCCACTCTCTCCTGCAGTGCCAGCTCA<br>AGTATAAGTTCCAATTACTTGCATTGGTATCAGCAGAAGCCAGGATTG<br>CCCCCTAGACTCTTGATTTATAGGACATCCAATCTGGCTTCTGGAATC<br>CCAGATCGCTTCAGTGGCAGTGGGTCTGGGACCGATTTCACTCTCACA<br>ATTAGCAGGATGGAGGCTGAAGATTTTGCCGTTTACTACTGCCAGCAG<br>GGTAGTAGTTTACCGTACACGTTCGGACAAGGGACCAAGCTTGAGATC<br>AAATCCGGAGGTGGTGGATCCGAGGTGCAGCTGGTCGAGTCTGGAGGA |

| SEQ ID NO. | DESIGNATION | SOURCE | TYPE | SEQUENCE |
|---|---|---|---|---|
| | | | | GGATTGGTGCAGCCTGGAGGGTCATTGAAACTCTCATGTGCAGCCTCT GGATTCACCTTCAATAAGTACGCCATGAACTGGGTCCGCCAGGCTCCA GGAAAGGGTTTGGAATGGGTTGCTCGCATAAGAAGTAAATATAATAAT TATGCAACATATTATGCCGATTCAGTGAAAGACAGGTTCACCATCTCC AGAGATGATTCAAAAAACACTGCCTATCTACAAATGAACAACTTGAAA ACTGAGGACACTGCCGTGTACTACTGTGTGAGACATGGGAACTTCGGT AATAGCTACATATCCTACTGGGCTTACTGGGGCCAAGGGACTCTGGTC ACCGTCTCCTCAGGTGGTGGTGGTTCTGGCGGCGGCGGCTCCGGTGGT GGTGGTTCTCAGACTGTTGTGACTCAGGAACCTTCACTCACCGTATCA CCTGGTGGAACAGTCACACTCACTTGTGGCTCCTCGACTGGGGCTGTT ACATCTGGCAACTACCCAAACTGGGTCCAACAAAAACCAGGTCAGGCA CCCCGTGGTCTAATAGGTGGGACTAAGTTCCTCGCCCCCGGTACTCCT GCCAGATTCTCAGGCTCCCTGCTTGGAGGCAAGGCTGCCCTCACCCTC TCAGGGGTACAGCCAGAGGATGAGGCAGAATATTACTGTGTTCTATGG TACAGCAACCGCTGGGTGTTCGGTGGAGGAACCAAACTGACTGTCCT |
| 421. | PMH8B1-VH | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSS |
| 422. | PMH8B1-HCDR1 | artificial | aa | DTYMD |
| 423. | PMH8B1-HCDR2 | artificial | aa | RIDPANGDSKYDPKFQG |
| 424. | PMH8B1-HCDR3 | artificial | aa | GGMIWYFDV |
| 425. | PMH8B1-VH | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCA |
| 426. | PMH8B1-VL | artificial | aa | EIVLTQSPATLSLSPGERATLSCSASSSISSNYLHWYQQKPGLPPRLL IYRTSNLASGIPDRFSGSGSGTDFTLTISRMEAEDFAVYYCQQGSSLP YTFGQGTKLEIK |
| 427. | PMH8B1-LCDR1 | artificial | aa | SASSSISSNYLH |
| 428. | PMH8B1-LCDR2 | artificial | aa | RTSNLAS |
| 429. | PMH8B1-LCDR3 | artificial | aa | QQGSSLPYT |
| 430. | PMH8B1-VL | artificial | nt | GAGATCGTGCTCACCCAGTCTCCAGCCACCCTGTCTCTATCTCCCGGG GAGAGGGCCACTCTCTCCTGCAGTGCCAGCTCAAGTATAAGTTCCAAT TACTTGCATTGGTATCAGCAGAAGCCAGGATTGCCCCCTAGACTCTTG ATTTATAGGACATCCAATCTGGCTTCTGGAATCCCAGATCGCTTCAGT GGCAGTGGGTCTGGGACCGATTTCACTCTCACAATTAGCAGGATGGAG GCTGAAGATTTTGCCGTTTACTACTGCCAGCAGGGTAGTAGTTTACCG TACACGTTCGGACAAGGGACCAAGCTTGAGATCAAA |
| 431. | PMH8B1-VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATL SLSPGERATLSCSASSSISSNYLHWYQQKPGLPPRLLIYRTSNLASGI PDRFSGSGSGTDFTLTISRMEAEDFAVYYCQQGSSLPYTFGQGTKLEI K |
| 432. | PMH8B1-VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCCTG TCTCTATCTCCCGGGGAGAGGGCCACTCTCTCCTGCAGTGCCAGCTCA AGTATAAGTTCCAATTACTTGCATTGGTATCAGCAGAAGCCAGGATTG CCCCCTAGACTCTTGATTTATAGGACATCCAATCTGGCTTCTGGAATC CCAGATCGCTTCAGTGGCAGTGGGTCTGGGACCGATTTCACTCTCACA ATTAGCAGGATGGAGGCTGAAGATTTTGCCGTTTACTACTGCCAGCAG GGTAGTAGTTTACCGTACACGTTCGGACAAGGGACCAAGCTTGAGATC AAA |

| SEQ ID NO. | DESIGNATION | SOURCE | TYPE | SEQUENCE |
|---|---|---|---|---|
| 433. | PMH8B1 VH-VL × I2C VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATL SLSPGERATLSCSASSSISSNYLHWYQQKPGLPPRLLIYRTSNLASGI PDRFSGSGSGTDFTLTISRMEAEDFAVYYCQQGSSLPYTFGQGTKLEI KSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVL |
| 434. | PMH8B1 VH-VL × I2C VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCCTG TCTCTATCTCCCGGGGAGAGGGCCACTCTCTCCTGCAGTGCCAGCTCA AGTATAAGTTCCAATTACTTGCATTGGTATCAGCAGAAGCCAGGATTG CCCCCTAGACTCTTGATTTATAGGACATCCAATCTGGCTTCTGGAATC CCAGATCGCTTCAGTGGCAGTGGGTCTGGGACCGATTTCACTCTCACA ATTAGCAGGATGGAGGCTGAAGATTTTGCCGTTTACTACTGCCAGCAG GGTAGTAGTTTACCGTACACGTTCGGACAAGGGACCAAGCTTGAGATC AAATCCGGAGGTGGTGGATCCGAGGTGCAGCTGGTCGAGTCTGGAGGA GGATTGGTGCAGCCTGGAGGGTCATTGAAACTCTCATGTGCAGCCTCT GGATTCACCTTCAATAAGTACGCCATGAACTGGGTCCGCCAGGCTCCA GGAAAGGGTTTGGAATGGGTTGCTCGCATAAGGAAGTAAATATAATAAT TATGCAACATATTATGCCGATTCAGTGAAAGACAGGTTCACCATCTCC AGAGATGATTCAAAAAACACTGCCTATCTACAAATGAACAACTTGAAA ACTGAGGACACTGCCGTGTACTACTGTGTGAGACATGGGAACTTCGGT AATAGCTACATATCCTACTGGGCTTACTGGGGCCAAGGGACTCTGGTC ACCGTCTCCTCAGGTGGTGGTGGTTCTGGCGGCGGCGGCTCCGGTGGT GGTGGTTCTCAGACTGTTGTGACTCAGGAACCTTCACTCACCGTATCA CCTGGTGGAACAGTCACACTCACTTGTGGCTCCTCGACTGGGGCTGTT ACATCTGGCAACTACCCAAACTGGGTCCAACAAAAACCAGGTCAGGCA CCCCGTGGTCTAATAGGTGGGACTAAGTTCCTCGCCCCCGGTACTCCT GCCAGATTCTCAGGCTCCCTGCTTGGAGGCAAGGCTGCCCTCACCCTC TCAGGGGTACAGCCAGAGGATGAGGCAGAATATTACTGTGTTCTATGG TACAGCAACCGCTGGGTGTTCGGTGGAGGAACCAAACTGACTGTCCT |
| 435. | PMH5B4-VH | artificial | aa | QVQLVQSGAEVVKKPGASVKVSCKASGYNFKDTYMDWVKQTPEQGLEWM GRIDPANGDSKYDPKFQGRVTITADTSTNTAYMELSSLRSEDTAVYYC ARGGMIWYFDVWGQGTTVTVSS |
| 436. | PMH5B4-HCDR1 | artificial | aa | DTYMD |
| 437. | PMH5B4-HCDR2 | artificial | aa | RIDPANGDSKYDPKFQG |
| 438. | PMH5B4-HCDR3 | artificial | aa | GGMIWYFDV |
| 439. | PMH5B4-VH | artificial | nt | CAGGTGCAGCTGGTCCAGTCTGGGGCAGAGGTTAAGAAGCCAGGGGCC TCAGTCAAGGTGTCCTGCAAAGCTTCTGGCTACAACTTTAAAGACACC TATATGGACTGGGTGAAGCAGACGCCTGAACAGGGCCTGGAATGGATG GGAAGGATTGATCCTGCGAATGGTGATAGTAAATATGACCCGAAATTC CAGGGCAGGGTCACTATAACAGCAGACACATCCACCAACACAGCCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCA |
| 440. | PMH5B4-VL | artificial | aa | EIVLTQSPTTLALSPGERVTLSCSASSSISSNYLHWYQQKPGLPPRLL IYRTSNLASGIPDRFSGSGSGTDFTLTISRLEPEDVAVYYCQQGSSLP YTFGQGTKLEIK |
| 441. | PMH5B4-LCDR1 | artificial | aa | SASSSISSNYLH |
| 442. | PMH5B4-LCDR2 | artificial | aa | RTSNLAS |
| 443. | PMH5B4-LCDR3 | artificial | aa | QQGSSLPYT |
| 444. | PMH5B4-VL | artificial | nt | GAGATCGTGCTCACCCAGTCTCCAACCACCCTGGCTCTATCTCCCGGG GAGAGGGTCACTCTCTCCTGCAGTGCCAGCTCTAGTATAAGTTCCAAT TACTTGCATTGGTATCAGCAGAAGCCAGGATTGCCCCCTAGACTCTTG |

| SEQ ID NO. | DESIGNATION | SOURCE | TYPE | SEQUENCE |
|---|---|---|---|---|
| | | | | ATTTATAGGACATCCAATCTGGCTTCTGGAATCCCAGATCGCTTCAGT<br>GGCAGTGGGTCTGGGACCGATTTCACTCTCACAATTAGCAGGCTGGAG<br>CCTGAAGATGTTGCCGTTTACTACTGCCAGCAGGGTAGTAGTTTACCG<br>TACACGTTCGGACAAGGGACCAAGCTTGAGATCAAA |
| 445. | PMH5B4-VH-VL | artificial | aa | QVQLVQSGAEVKKPGASVKVSCKASGYNFKDTYMDWVKQTPEQGLEWM<br>GRIDPANGDSKYDPKFQGRVTITADTSTNTAYMELSSLRSEDTAVYYC<br>ARGGMIWYFDVWGQGTTVTVSSGGGGSGGGGSGGGGSEIVLTQSPTTL<br>ALSPGERVTLSCSASSSISSNYLHWYQQKPGLPPRLLIYRTSNLASGI<br>PDRFSGSGSGTDFTLTISRLEPEDVAVYYCQQGSSLPYTFGQGTKLEI<br>K |
| 446. | PMH5B4-VH-VL | artificial | nt | CAGGTGCAGCTGGTCCAGTCTGGGGCAGAGGTTAAGAAGCCAGGGGCC<br>TCAGTCAAGGTGTCCTGCAAAGCTTCTGGCTACAACTTTAAAGACACC<br>TATATGGACTGGGTGAAGCAGACGCCTGAACAGGGCCTGGAATGGATG<br>GGAAGGATTGATCCTGCAATGGTGATAGTAAATATGACCCGAAATTC<br>CAGGGCAGGGTCACTATAACAGCAGACACATCCACCAACACAGCCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCAGGTGGTGGTGGTTCTGGCGGCGGCGGCTCC<br>GGTGGTGGTGGTTCTGAGATCGTGCTCACCCAGTCTCCAACCACCCTG<br>GCTCTATCTCCCGGGGAGAGGGTCACTCTCTCCTGCAGTGCCAGCTCT<br>AGTATAAGTTCCAATTACTTGCATTGGTATCAGCAGAAGCCAGGATTG<br>CCCCCTAGACTCTTGATTTATAGGACATCCAATCTGGCTTCTGGAATC<br>CCAGATCGCTTCAGTGGCAGTGGGTCTGGGACCGATTTCACTCTCACA<br>ATTAGCAGGCTGGAGCCTGAAGATGTTGCCGTTTACTACTGCCAGCAG<br>GGTAGTAGTTTACCGTACACGTTCGGACAAGGGACCAAGCTTGAGATC<br>AAA |
| 447. | PMH5B4 VH-VL × I2C VH-VL | artificial | aa | QVQLVQSGAEVKKPGASVKVSCKASGYNFKDTYMDWVKQTPEQGLEWM<br>GRIDPANGDSKYDPKFQGRVTITADTSTNTAYMELSSLRSEDTAVYYC<br>ARGGMIWYFDVWGQGTTVTVSSGGGGSGGGGSGGGGSEIVLTQSPTTL<br>ALSPGERVTLSCSASSSISSNYLHWYQQKPGLPPRLLIYRTSNLASGI<br>PDRFSGSGSGTDFTLTISRLEPEDVAVYYCQQGSSLPYTFGQGTKLEI<br>KSGGGGSEVQLVESGGGLVQPGGSLKLSCAASGFTFNKYAMNWVRQAP<br>GKGLEWVARIRSKYNNYATYYADSVKDRFTISRDDSKNTAYLQMNNLK<br>TEDTAVYYCVRHGNFGNSYISYWAYWGQGTLVTVSSGGGGSGGGGSGG<br>GGSQTVVTQEPSLTVSPGGTVTLTCGSSTGAVTSGNYPNWVQQKPGQA<br>PRGLIGGTKFLAPGTPARFSGSLLGGKAALTLSGVQPEDEAEYYCVLW<br>YSNRWVFGGGTKLTVL |
| 448. | PMH5B4 VH-VL × I2C VH-VL | artificial | nt | CAGGTGCAGCTGGTCCAGTCTGGGGCAGAGGTTAAGAAGCCAGGGGCC<br>TCAGTCAAGGTGTCCTGCAAAGCTTCTGGCTACAACTTTAAAGACACC<br>TATATGGACTGGGTGAAGCAGACGCCTGAACAGGGCCTGGAATGGATG<br>GGAAGGATTGATCCTGCAATGGTGATAGTAAATATGACCCGAAATTC<br>CAGGGCAGGGTCACTATAACAGCAGACACATCCACCAACACAGCCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCAGGTGGTGGTGGTTCTGGCGGCGGCGGCTCC<br>GGTGGTGGTGGTTCTGAGATCGTGCTCACCCAGTCTCCAACCACCCTG<br>GCTCTATCTCCCGGGGAGAGGGTCACTCTCTCCTGCAGTGCCAGCTCT<br>AGTATAAGTTCCAATTACTTGCATTGGTATCAGCAGAAGCCAGGATTG<br>CCCCCTAGACTCTTGATTTATAGGACATCCAATCTGGCTTCTGGAATC<br>CCAGATCGCTTCAGTGGCAGTGGGTCTGGGACCGATTTCACTCTCACA<br>ATTAGCAGGCTGGAGCCTGAAGATGTTGCCGTTTACTACTGCCAGCAG<br>GGTAGTAGTTTACCGTACACGTTCGGACAAGGGACCAAGCTTGAGATC<br>AAATCCGGAGGTGGTGGATCCGAGGTGCAGCTGGTCGAGTCTGGAGGA<br>GGATTGGTGCAGCCTGGAGGGTCATTGAAACTCTCATGTGCAGCCTCT<br>GGATTCACCTTCAATAAGTACGCCATGAACTGGGTCCGCCAGGCTCCA<br>GGAAAGGGTTTGGAATGGGTTGCTCGCATAAGAAGTAAATATAATAAT<br>TATGCAACATATTATGCCGATTCAGTGAAAGACAGGTTCACCATCTCC<br>AGAGATGATTCAAAAAACACTGCCTATCTACAAATGAACAACTTGAAA<br>ACTGAGGACACTGCCGTGTACTACTGTGTGAGACATGGGAACTTCGGT<br>AATAGCTACATATCCTACTGGGCTTACTGGGGCCAAGGGACTCTGGTC<br>ACCGTCTCCTCAGGTGGTGGTGGTTCTGGCGGCGGCGGCTCCGGTGGT<br>GGTGGTTCTGACAGTGTTGTGACTCAGGAACCTTCACTCACCGTATCA<br>CCTGGTGGAACAGTCACACTCACTTGTGGCCTCTCGACTGGGGCTGTT<br>ACATCTGGCAACTACCCAAACTGGGTCCAACAAAAACCAGGTCAGGCA<br>CCCCGTGGTCTAATAGGTGGGACTAAGTTCCTCGCCCCCGGTACTCCT<br>GCCAGATTCTCAGGCTCCCTGCTTGGAGGCAAGGCTGCCCTCACCCTC<br>TCAGGGGTACAGCCAGAGGATGAGGCAGAATATTACTGTGTTCTATGG<br>TACAGCAACCGCTGGGTGTTCGGTGGAGGAACCAAACTGACTGTCCTA |
| 449. | PMH8B4-VH | artificial | aa | QVQLVQSGAEVVKPGASVKLSCKASGFTITDTYMDWVRQAPGQGLEWI<br>GRIDPANGDSKYDPKFQGRATITPDTSTNTVYMELSSLRSEDTAVYYC<br>ARGGMIWYFDVWGQGTTVTVSS |

| SEQ ID NO. | DESIGNATION | SOURCE | TYPE | SEQUENCE |
|---|---|---|---|---|
| 450. | PMH8B4-HCDR1 | artificial | aa | DTYMD |
| 451. | PMH8B4-HCDR2 | artificial | aa | RIDPANGDSKYDPKFQG |
| 452. | PMH8B4-HCDR3 | artificial | aa | GGMIWYFDV |
| 453. | PMH8B4-VH | artificial | nt | CAGGTGCAGCTGGTCCAGTCTGGGGCAGAGGTTGTGAAGCCAGGGGCC<br>TCAGTCAAGTTGTCCTGCAAAGCTTCTGGCTTCACCATTACAGACACC<br>TATATGGACTGGGTGAGGCAGGCGCCTGGACAGGGCCTGGAATGGATT<br>GGAAGGATTGATCCTGCGAATGGTGATAGTAAATATGACCCGAAATTC<br>CAGGGCAGGGCCACTATAACACCAGACACATCCACCAACACAGTCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCA |
| 454. | PMH8B4-VL | artificial | aa | EIVLTQSPTTLALSPGERVTLSCSASSSISSNYLHWYQQKPGLPPRLL<br>IYRTSNLASGIPDRFSGSGSGTDFTLTISRLEPEDVAVYYCQQGSSLP<br>YTFGQGTKLEIK |
| 455. | PMH8B4-LCDR1 | artificial | aa | SASSSISSNYLH |
| 456. | PMH8B4-LCDR2 | artificial | aa | RTSNLAS |
| 457. | PMH8B4-LCDR3 | artificial | aa | QQGSSLPYT |
| 458. | PMH8B4-VL | artificial | nt | GAGATCGTGCTCACCCAGTCTCCAACCACCCTGGCTCTATCTCCCGGG<br>GAGAGGGTCACTCTCTCCTGCAGTGCCAGCTCTAGTATAAGTTCCAAT<br>TACTTGCATTGGTATCAGCAGAAGCCAGGATTGCCCCCTAGACTCTTG<br>ATTTATAGGACATCCAATCTGGCTTCTGGAATCCCAGATCGCTTCAGT<br>GGCAGTGGGTCTGGGACCGATTTCACTCTCACAATTAGCAGGCTGGAG<br>CCTGAAGATGTTGCCGTTTACTACTGCCAGCAGGGTAGTAGTTTACCG<br>TACACGTTCGGACAAGGGACCAAGCTTGAGATCAAA |
| 459. | PMH8B4-VH-VL | artificial | aa | QVQLVQSGAEVVKPGASVKLSCKASGFTITDTYMDWVRQAPGQGLEWI<br>GRIDPANGDSKYDPKFQGRATITPDTSTNTVYMELSSLRSEDTAVYYC<br>ARGGMIWYFDVWGQGTTVTVSSGGGGSGGGGSGGGGSEIVLTQSPTTL<br>ALSPGERVTLSCSASSSISSNYLHWYQQKPGLPPRLLIYRTSNLASGI<br>PDRFSGSGSGTDFTLTISRLEPEDVAVYYCQQGSSLPYTFGQGTKLEI<br>K |
| 460. | PMH8B4-VH-VL | artificial | nt | CAGGTGCAGCTGGTCCAGTCTGGGGCAGAGGTTGTGAAGCCAGGGGCC<br>TCAGTCAAGTTGTCCTGCAAAGCTTCTGGCTTCACCATTACAGACACC<br>TATATGGACTGGGTGAGGCAGGCGCCTGGACAGGGCCTGGAATGGATT<br>GGAAGGATTGATCCTGCGAATGGTGATAGTAAATATGACCCGAAATTC<br>CAGGGCAGGGCCACTATAACACCAGACACATCCACCAACACAGTCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCAGGTGGTGGTGGTTCTGGCGGCGGCGGCTCC<br>GGTGGTGGTGGTTCTGAGATCGTGCTCACCCAGTCTCCAACCACCCTG<br>GCTCTATCTCCCGGGGAGAGGGTCACTCTCTCCTGCAGTGCCAGCTCT<br>AGTATAAGTTCCAATTACTTGCATTGGTATCAGCAGAAGCCAGGATTG<br>CCCCCTAGACTCTTGATTTATAGGACATCCAATCTGGCTTCTGGAATC<br>CCAGATCGCTTCAGTGGCAGTGGGTCTGGGACCGATTTCACTCTCACA<br>ATTAGCAGGCTGGAGCCTGAAGATGTTGCCGTTTACTACTGCCAGCAG<br>GGTAGTAGTTTACCGTACACGTTCGGACAAGGGACCAAGCTTGAGATC<br>AAA |
| 461. | PMH8B4 VH-VL x I2C VH-VL | artificial | aa | QVQLVQSGAEVVKPGASVKLSCKASGFTITDTYMDWVRQAPGQGLEWI<br>GRIDPANGDSKYDPKFQGRATITPDTSTNTVYMELSSLRSEDTAVYYC<br>ARGGMIWYFDVWGQGTTVTVSSGGGGSGGGGSGGGGSEIVLTQSPTTL<br>ALSPGERVTLSCSASSSISSNYLHWYQQKPGLPPRLLIYRTSNLASGI<br>PDRFSGSGSGTDFTLTISRLEPEDVAVYYCQQGSSLPYTFGQGTKLEI<br>KSGGGGSEVQLVESGGGLVQPGGSLKLSCAASGFTFNKYAMNWVRQAP<br>GKGLEWVARIRSKYNNYATYYADSVKDRFTISRDDSKNTAYLQMNNLK<br>TEDTAVYYCVRHGNFGNSYISYWAYWGQGTLVTVSSGGGGSGGGGSGG<br>GGSQTVVTQEPSLTVSPGGTVTLTCGSSTGAVTSGNYPNWVQQKPGQA<br>PRGLIGGTKFLAPGTPARFSGSLLGGKAALTLSGVQPEDEAEYYCVLW<br>YSNRWVFGGGTKLTVL |
| 462. | PMH8B4 VH-VL x I2C VH-VL | artificial | nt | CAGGTGCAGCTGGTCCAGTCTGGGGCAGAGGTTGTGAAGCCAGGGGCC<br>TCAGTCAAGTTGTCCTGCAAAGCTTCTGGCTTCACCATTACAGACACC<br>TATATGGACTGGGTGAGGCAGGCGCCTGGACAGGGCCTGGAATGGATT<br>GGAAGGATTGATCCTGCGAATGGTGATAGTAAATATGACCCGAAATTC<br>CAGGGCAGGGCCACTATAACACCAGACACATCCACCAACACAGTCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC |

| SEQ ID NO. | DESIGNATION | SOURCE | TYPE | SEQUENCE |
|---|---|---|---|---|
| | | | | ACGGTCACCGTCTCCTCAGGTGGTGGTGGTTCTGGCGGCGGCGGCTCC |
| | | | | GGTGGTGGTGGTTCTGAGATCGTGCTCACCCAGTCTCCAACCACCCTG |
| | | | | GCTCTATCTCCCGGGGAGAGGGTCACTCTCTCCTGCAGTGCCAGCTCT |
| | | | | AGTATAAGTTCCAATTACTTGCATTGGTATCAGCAGAAGCCAGGATTG |
| | | | | CCCCCTAGACTCTTGATTTATAGGACATCCAATCTGGCTTCTGGAATC |
| | | | | CCAGATCGCTTCAGTGGCAGTGGGTCTGGGACCGATTTCACTCTCACA |
| | | | | ATTAGCAGGCTGGAGCCTGAAGATGTTGCCGTTTACTACTGCCAGCAG |
| | | | | GGTAGTAGTTTACCGTACACGTTCGGACAAGGGACCAAGCTTGAGATC |
| | | | | AAATCCGGAGGTGTGGATCCGAGGTGCAGCTGGTCGAGTCTGGAGGA |
| | | | | GGATTGGTGCAGCCTGGAGGGTCATTGAAACTCTCATGTGCAGCCTCT |
| | | | | GGATTCACCTTCAATAAGTACGCCATGAACTGGGTCCGCCAGGCTCCA |
| | | | | GGAAAGGGTTTGGAATGGGTTGCTCGCATAAGAAGTAAATATAATAAT |
| | | | | TATGCAACATATTATGCCGATTCAGTGAAAGACAGGTTCACCATCTCC |
| | | | | AGAGATGATTCAAAAAACACTGCCTATCTACAAATGAACAACTTGAAA |
| | | | | ACTGAGGACACTGCCGTGTACTACTGTGTGAGACATGGGAACTTCGGT |
| | | | | AATAGCTACATATCCTACTGGGCTTACTGGGGCCAAGGGACTCTGGTC |
| | | | | ACCGTCTCCTCAGGTGGTGGTGGTTCTGGCGGCGGCGGCTCCGGTGGT |
| | | | | GGTGGTTCTCAGACTGTTGTGACTCAGGAACCTTCACTCACCGTATCA |
| | | | | CCTGGTGGAACAGTCACACTCACTTGTGGCTCCTCGACTGGGGCTGTT |
| | | | | ACATCTGGCAACTACCCAAACTGGGTCCAACAAAAACCAGGTCAGGCA |
| | | | | CCCCGTGGTCTAATAGGTGGGACTAAGTTCCTCGCCCCCGGTACTCCT |
| | | | | GCCAGATTCTCAGGCTCCCTGCTTGGAGGCAAGGCTGCCCTCACCCTC |
| | | | | TCAGGGGTACAGCCAGAGGATGAGGCAGAATATTACTGTGTTCTATGG |
| | | | | TACAGCAACCGCTGGGTGTTCGGTGGAGGAACCAAACTGACTGTCCTA |
| 463. | PMH5C2-VH | artificial | aa | QVQLVQSGAEVKKPGASVKVSCKASGYNFKDTYMDWVKQTPEQGLEWM |
| | | | | GRIDPANGDSKYDPKFQGRVTITADTSTNTAYMELSSLRSEDTAVYYC |
| | | | | ARGGMIWYFDVWGQGTTVTVSS |
| 464. | PMH5C2-HCDR1 | artificial | aa | DTYMD |
| 465. | PMH5C2-HCDR2 | artificial | aa | RIDPANGDSKYDPKFQG |
| 466. | PMH5C2-HCDR3 | artificial | aa | GGMIWYFDV |
| 467. | PMH5C2-VH | artificial | nt | CAGGTGCAGCTGGTCCAGTCTGGGGCAGAGGTTAAGAAGCCAGGGGCC |
| | | | | TCAGTCAAGGTGTCCTGCAAAGCTTCTGGCTACAACTTTAAAGACACC |
| | | | | TATATGGACTGGGTGAAGCAGACGCCTGAACAGGGCCTGGAATGGATG |
| | | | | GGAAGGATTGATCCTGCGAATGGTGATAGTAAATATGACCCGAAATTC |
| | | | | CAGGGCAGGGTCACTATAACAGCAGACACATCCACCAACACAGCCTAC |
| | | | | ATGGAGCTCAGCAGCCTGAGATCTGAGGACACTGCCGTCTATTATTGT |
| | | | | GCTAGAGGCGGGATGATATGGTACTTCGATGTCTGGGGCCAAGGGACC |
| | | | | ACGGTCACCGTCTCCTCA |
| 468. | PMH5C2-VL | artificial | aa | EIVLTQSPATLSVSPGERATLSCSASSSISSNYLHWYQQKPGLPRLL |
| | | | | IYRTSNLASGIPARFSGSGSGTAFTLTISRLEPEDFAVYYCQQGSSLP |
| | | | | YTFGQGTKLEIK |
| 469. | PMH5C2-LCDR1 | artificial | aa | SASSSISSNYLH |
| 470. | PMH5C2-LCDR2 | artificial | aa | RTSNLAS |
| 471. | PMH5C2-LCDR3 | artificial | aa | QQGSSLPYT |
| 472. | PMH5C2-VL | artificial | nt | GAGATCGTGCTCACCCAGTCTCCAGCCACCCTGTCTGTATCTCCCGGG |
| | | | | GAGAGGGCCACTCTCTCCTGCAGTGCCAGCTCAAGTATAAGTTCCAAT |
| | | | | TACTTGCATTGGTATCAGCAGAAGCCAGGATTATCCCCTAGACTCTTG |
| | | | | ATTTATAGGACATCCAATCTGGCTTCTGGAATCCCAGCTCGCTTCAGT |
| | | | | GGCAGTGGGTCTGGGACCGCTTTCACTCTCACAATTAGCAGGCTGGAG |
| | | | | CCTGAAGATTTTGCCGTTTACTACTGCCAGCAGGGTAGTAGTTTACCG |
| | | | | TACACGTTCGGACAAGGGACCAAGCTTGAGATCAAA |
| 473. | PMH5C2-VH-VL | artificial | aa | QVQLVQSGAEVKKPGASVKVSCKASGYNFKDTYMDWVKQTPEQGLEWM |
| | | | | GRIDPANGDSKYDPKFQGRVTITADTSTNTAYMELSSLRSEDTAVYYC |
| | | | | ARGGMIWYFDVWGQGTTVTVSSGGGGSGGGGSGGGGSEIVLTQSPATL |
| | | | | SVSPGERATLSCSASSSISSNYLHWYQQKPGLSPRLLIYRTSNLASGI |
| | | | | PARFSGSGSGTAFTLTISRLEPEDFAVYYCQQGSSLPYTFGQGTKLEI |
| | | | | K |
| 474. | PMH5C2-VH-VL | artificial | nt | CAGGTGCAGCTGGTCCAGTCTGGGGCAGAGGTTAAGAAGCCAGGGGCC |
| | | | | TCAGTCAAGGTGTCCTGCAAAGCTTCTGGCTACAACTTTAAAGACACC |
| | | | | TATATGGACTGGGTGAAGCAGACGCCTGAACAGGGCCTGGAATGGATG |
| | | | | GGAAGGATTGATCCTGCGAATGGTGATAGTAAATATGACCCGAAATTC |
| | | | | CAGGGCAGGGTCACTATAACAGCAGACACATCCACCAACACAGCCTAC |
| | | | | ATGGAGCTCAGCAGCCTGAGATCTGAGGACACTGCCGTCTATTATTGT |
| | | | | GCTAGAGGCGGGATGATATGGTACTTCGATGTCTGGGGCCAAGGGACC |
| | | | | ACGGTCACCGTCTCCTCAGGTGGTGGTGGTTCTGGCGGCGGCGGCTCC |

| SEQ ID NO. | DESIGNATION | SOURCE | TYPE | SEQUENCE |
|---|---|---|---|---|
| | | | | GGTGGTGGTGGTTCTGAGATCGTGCTCACCCAGTCTCCAGCCACCCTG<br>TCTGTATCTCCCGGGGAGAGGGCCACTCTCTCCTGCAGTGCCAGCTCA<br>AGTATAAGTTCCAATTACTTGCATTGGTATCAGCAGAAGCCAGGATTA<br>TCCCCTAGACTCTTGATTTATAGGACATCCAATCTGGCTTCTGGAATC<br>CCAGCTCGCTTCAGTGGCAGTGGGTCTGGGACCGCTTTCACTCTCACA<br>ATTAGCAGGCTGGAGCCTGAAGATTTTGCCGTTTACTACTGCCAGCAG<br>GGTAGTAGTTTACCGTACACGTTCGGACAAGGGACCAAGCTTGAGATC<br>AAA |
| 475. | PMH5C2 VH-VL × I2C VH-VL | artificial | aa | QVQLVQSGAEVKKPGASVKVSCKASGYNFKDTYMDWVKQTPEQGLEWM<br>GRIDPANGDSKYDPKFQGRVTITADTSTNTAYMELSSLRSEDTAVYYC<br>ARGGMIWYFDVWGQGTTVTVSSGGGGSGGGGSGGGGSEIVLTQSPATL<br>SVSPGERATLSCSASSSISSNYLHWYQQKPGLSPRLLIYRTSNLASGI<br>PARFSGSGSGTAFTLTISRLEPEDFAVYYCQQGSSLPYTFGQGTKLEI<br>KSGGGGSEVQLVESGGGLVQPGGSLKLSCAASGFTFNKYAMNWVRQAP<br>GKGLEWVARIRSKYNNYATYYADSVKDRFTISRDDSKNTAYLQMNNLK<br>TEDTAVYYCVRHGNFGNSYISYWAYWGQGTLVTVSSGGGGSGGGGSGG<br>GGSQTVVTQEPSLTVSPGGTVTLTCGSSTGAVTSGNYPNWVQQKPGQA<br>PRGLIGGTKFLAPGTPARFSGSLLGGKAALTLSGVQPEDEAEYYCVLW<br>YSNRWVFGGGTKLTVL |
| 476. | PMH5C2 VH-VL × I2C VH-VL | artificial | nt | CAGGTGCAGCTGGTCCAGTCTGGGGCAGAGGTTAAGAAGCCAGGGGCC<br>TCAGTCAAGGTGTCCTGCAAAGCTTCTGGCTACAACTTTAAAGACACC<br>TATATGGACTGGGTGAAGCAGACGCCTGAACAGGGCCTGGAATGGATG<br>GGAAGGATTGATCCTGCGAATGGTGATAGTAAATATGACCCGAAATTC<br>CAGGGCAGGGTCACTATAACAGCAGACACATCCACCAACACAGCCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCAGGTGGTGGTGGTTCTGGCGGCGGCGGCTCC<br>GGTGGTGGTGGTTCTGAGATCGTGCTCACCCAGTCTCCAGCCACCCTG<br>TCTGTATCTCCCGGGGAGAGGGCCACTCTCTCCTGCAGTGCCAGCTCA<br>AGTATAAGTTCCAATTACTTGCATTGGTATCAGCAGAAGCCAGGATTA<br>TCCCCTAGACTCTTGATTTATAGGACATCCAATCTGGCTTCTGGAATC<br>CCAGCTCGCTTCAGTGGCAGTGGGTCTGGGACCGCTTTCACTCTCACA<br>ATTAGCAGGCTGGAGCCTGAAGATTTTGCCGTTTACTACTGCCAGCAG<br>GGTAGTAGTTTACCGTACACGTTCGGACAAGGGACCAAGCTTGAGATC<br>AAATCCGGAGGTGTGGATCCGAGGTGCAGCTGGTCGAGTCTGGAGGA<br>GGATTGGTGCAGCCTGGAGGGTCATTGAAACTCTCATGTGCAGCCTCT<br>GGATTCACCTTCAATAAGTACGCCATGAACTGGGTCCGCCAGGCTCCA<br>GGAAAGGGTTTGGAATGGGTTGCTCGCATAAGAAGTAAATATAATAAT<br>TATGCAACATATTATGCCGATTCAGTGAAAGACAGGTTCACCATCTCC<br>AGAGATGATTCAAAAAACACTGCCTATCTACAAATGAACAACTTGAAA<br>ACTGAGGACACTGCCGTGTACTACTGTGTGAGACATGGGAACTTCGGT<br>AATAGCTACATATCCTACTGGGCTTACTGGGGCCAAGGGACTCTGGTC<br>ACCGTCTCCTCAGGTGGTGGTGGTTCTGGCGGCGGCGGCTCCGGTGGT<br>GGTGGTTCTCAGACTGTTGTGACTCAGGAACCTTCACTCACCGTATCA<br>CCTGGTGGAACAGTCACACTCACTTGTGGCTCCTCGACTGGGGCTGTT<br>ACATCTGGCAACTACCCAAACTGGGTCCAACAAAAACCAGGTCAGGCA<br>CCCCGTGGTCTAATAGGTGGGACTAAGTTCCTCGCCCCCGGTACTCCT<br>GCCAGATTCTCAGGCTCCCTGCTTGGAGGCAAGGCTGCCCTCACCCTC<br>TCAGGGGTACAGCCAGAGGATGAGGCAGAATATTACTGTGTTCTATGG<br>TACAGCAACCGCTGGGTGTTCGGTGGAGGAACCAAACTGACTGTCCTA |
| 477. | PMH8C2-VH | artificial | aa | QVQLVQSGAEVVKPGASVKLSCKASGFTITDTYMDWVRQAPGQGLEWI<br>GRIDPANGDSKYDPKFQGRATITPDTSTNTVYMELSSLRSEDTAVYYC<br>ARGGMIWYFDVWGQGTTVTVSS |
| 478. | PMH8C2-HCDR1 | artificial | aa | DTYMD |
| 479. | PMH8C2-HCDR2 | artificial | aa | RIDPANGDSKYDPKFQG |
| 480. | PMH8C2-HCDR3 | artificial | aa | GGMIWYFDV |
| 481. | PMH8C2-VH | artificial | nt | CAGGTGCAGCTGGTCCAGTCTGGGGCAGAGGTTGTGAAGCCAGGGGCC<br>TCAGTCAAGTTGTCCTGCAAAGCTTCTGGCTTCACCATTACAGACACC<br>TATATGGACTGGGTGAGGCAGGCGCCTGGACAGGGCCTGGAATGGATT<br>GGAAGGATTGATCCTGCGAATGGTGATAGTAAATATGACCCGAAATTC<br>CAGGGCAGGGCCACTATAACACCAGACACATCCACCAACACAGTCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCA |
| 482. | PMH8C2-VL | artificial | aa | EIVLTQSPATLSVSPGERATLSCSASSSISSNYLHWYQQKPGLSPRLL<br>IYRTSNLASGIPARFSGSGSGTAFTLTISRLEPEDFAVYYCQQGSSLP<br>YTFGQGTKLEIK |

| SEQ ID NO. | DESIGNATION | SOURCE | TYPE | SEQUENCE |
|---|---|---|---|---|
| 483. | PMH8C2-LCDR1 | artificial | aa | SASSSISSNYLH |
| 484. | PMH8C2-LCDR2 | artificial | aa | RTSNLAS |
| 485. | PMH8C2-LCDR3 | artificial | aa | QQGSSLPYT |
| 486. | PMH8C2-VL | artificial | nt | GAGATCGTGCTCACCCAGTCTCCAGCCACCCTGTCTGTATCTCCCGGG GAGAGGGCCACTCTCTCCTGCAGTGCCAGCTCAAGTATAAGTTCCAAT TACTTGCATTGGTATCAGCAGAAGCCAGGATTATCCCCTAGACTCTTG ATTTATAGGACATCCAATCTGGCTTCTGGAATCCCAGCTCGCTTCAGT GGCAGTGGGTCTGGGACCGCTTTCACTCTCACAATTAGCAGGCTGGAG CCTGAAGATTTTGCCGTTTACTACTGCCAGCAGGGTAGTAGTTTACCG TACACGTTCGGACAAGGGACCAAGCTTGAGATCAAA |
| 487. | PMH8C2-VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATL SVSPGERATLSCSASSSISSNYLHWYQQKPGLSPRLLIYRTSNLASGI PARFSGSGSGTAFTLTISRLEPEDFAVYYCQQGSSLPYTFGQGTKLEI K |
| 488. | PMH8C2-VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCCTG TCTGTATCTCCCGGGGAGAGGGCCACTCTCTCCTGCAGTGCCAGCTCA AGTATAAGTTCCAATTACTTGCATTGGTATCAGCAGAAGCCAGGATTA TCCCCTAGACTCTTGATTTATAGGACATCCAATCTGGCTTCTGGAATC CCAGCTCGCTTCAGTGGCAGTGGGTCTGGGACCGCTTTCACTCTCACA ATTAGCAGGCTGGAGCCTGAAGATTTTGCCGTTTACTACTGCCAGCAG GGTAGTAGTTTACCGTACACGTTCGGACAAGGGACCAAGCTTGAGATC AAA |
| 489. | PMH8C2 VH-VL × I2C VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATL SVSPGERATLSCSASSSISSNYLHWYQQKPGLSPRLLIYRTSNLASGI PARFSGSGSGTAFTLTISRLEPEDFAVYYCQQGSSLPYTFGQGTKLEI KSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVL |
| 490. | PMH8C2 VH-VL × I2C VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCCTG TCTGTATCTCCCGGGGAGAGGGCCACTCTCTCCTGCAGTGCCAGCTCA AGTATAAGTTCCAATTACTTGCATTGGTATCAGCAGAAGCCAGGATTA TCCCCTAGACTCTTGATTTATAGGACATCCAATCTGGCTTCTGGAATC CCAGCTCGCTTCAGTGGCAGTGGGTCTGGGACCGCTTTCACTCTCACA ATTAGCAGGCTGGAGCCTGAAGATTTTGCCGTTTACTACTGCCAGCAG GGTAGTAGTTTACCGTACACGTTCGGACAAGGGACCAAGCTTGAGATC AAATCCGGAGGTGGTGGATCCGAGGTGCAGCTGGTCGAGTCTGGAGGA GGATTGGTGCAGCCTGGAGGGTCATTGAAACTCTCATGTGCAGCCTCT GGATTCACCTTCAATAAGTACGCCATGAACTGGGTCCGCCAGGCTCCA GGAAAGGGTTTGGAATGGGTTGCTCGCATAAGAAGTAAATATAATAAT TATGCAACATATTATGCCGATTCAGTGAAAGACAGGTTCACCATCTCC AGAGATGATTCAAAAAACACTGCCTATCTACAAATGAACAACTTGAAA ACTGAGGACACTGCCGTGTACTACTGTGTGAGACATGGGAACTTCGGT AATAGCTACATATCCTACTGGGCTTACTGGGGCCAAGGGACTCTGGTC ACCGTCTCCTCAGGTGGTGGTGGTTCTGGCGGCGGCGGCTCCGGTGGT GGTGGTTCTCAGACTGTTGTGACTCAGGAACCTTCACTCACCGTATCA CCTGGTGGAACAGTCACACTCACTTGTGGCTTCCTCGACTGGGGCTGTT |

| SEQ ID NO. | DESIGNATION | SOURCE | TYPE | SEQUENCE |
|---|---|---|---|---|
| | | | | ACATCTGGCAACTACCCAAACTGGGTCCAACAAAAACCAGGTCAGGCA CCCCGTGGTCTAATAGGTGGGACTAAGTTCCTCGCCCCCGGTACTCCT GCCAGATTCTCAGGCTCCCTGCTTGGAGGCAAGGCTGCCCTCACCCTC TCAGGGGTACAGCCAGAGGATGAGGCAGAATATTACTGTGTTCTATGG TACAGCAACCGCTGGGTGTTCGGTGGAGGAACCAAACTGACTGTCCTA |
| 491. | PMH5D1-VH | artificial | aa | QVQLVQSGAEVKKPGASVKVSCKASGYNFKDTYMDWVKQTPEQGLEWM GRIDPANGDSKYDPKFQGRVTITADTSTNTAYMELSSLRSEDTAVYYC ARGGMIWYFDVWGQGTTVTVSS |
| 492. | PMH5D1-HCDR1 | artificial | aa | DTYMD |
| 493. | PMH5D1-HCDR2 | artificial | aa | RIDPANGDSKYDPKFQG |
| 494. | PMH5D1-HCDR3 | artificial | aa | GGMIWYFDV |
| 495. | PMH5D1-VH | artificial | nt | CAGGTGCAGCTGGTCCAGTCTGGGGCAGAGGTTAAGAAGCCAGGGGCC TCAGTCAAGGTGTCCTGCAAAGCTTCTGGCTACAACTTTAAAGACACC TATATGGACTGGGTGAAGCAGACGCCTGAACAGGGCCTGGAATGGATG GGAAGGATTGATCCTGCGAATGGTGATAGTAAATATGACCCGAAATTC CAGGGCAGGGTCACTATAACAGCAGACACATCCACCAACACAGCCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCA |
| 496. | PMH5D1-VL | artificial | aa | EIVLTQSPATLSLSPGERATLSCSASSSISSNYLHWYQQKPGLPPRLL IYRTSNLASGIPARFSGSGSGTDFTLTISRLEPEDVAVYYCQQGSSLP YTFGQGTKLEIK |
| 497. | PMH5D1-LCDR1 | artificial | aa | SASSSISSNYLH |
| 498. | PMH5D1-LCDR2 | artificial | aa | RTSNLAS |
| 499. | PMH5D1-LCDR3 | artificial | aa | QQGSSLPYT |
| 500. | PMH5D1-VL | artificial | nt | GAGATCGTGCTCACCCAGTCTCCAGCCACCCTGTCTCTATCTCCCGGG GAGAGGGCCACTCTCTCCTGCAGTGCCAGCTCAAGTATAAGTTCCAAT TACTTGCATTGGTATCAGCAGAAGCCAGGATTACCCCCTAGACTCTTG ATTTATAGGACATCCAATCTGGCTTCTGGAATCCCAGCTCGCTTCAGT GGCAGTGGGTCTGGGACCGATTTCACTCTCACAATTAGCAGGCTGGAG CCTGAAGATGTTGCCGTTTACTACTGCCAGCAGGGTAGTAGTTTACCG TACACGTTCGGACAAGGGACCAAGCTTGAGATCAAA |
| 501. | PMH5D1-VH-VL | artificial | aa | QVQLVQSGAEVKKPGASVKVSCKASGYNFKDTYMDWVKQTPEQGLEWM GRIDPANGDSKYDPKFQGRVTITADTSTNTAYMELSSLRSEDTAVYYC ARGGMIWYFDVWGQGTTVTVSSGGGGSGGGGSGGGGSEIVLTQSPATL SLSPGERATLSCSASSSISSNYLHWYQQKPGLPPRLLIYRTSNLASGI PARFSGSGSGTDFTLTISRLEPEDVAVYYCQQGSSLPYTFGQGTKLEI K |
| 502. | PMH5D1-VH-VL | artificial | nt | CAGGTGCAGCTGGTCCAGTCTGGGGCAGAGGTTAAGAAGCCAGGGGCC TCAGTCAAGGTGTCCTGCAAAGCTTCTGGCTACAACTTTAAAGACACC TATATGGACTGGGTGAAGCAGACGCCTGAACAGGGCCTGGAATGGATG GGAAGGATTGATCCTGCGAATGGTGATAGTAAATATGACCCGAAATTC CAGGGCAGGGTCACTATAACAGCAGACACATCCACCAACACAGCCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCCTG TCTCTATCTCCCGGGGAGAGGGCCACTCTCTCCTGCAGTGCCAGCTCA AGTATAAGTTCCAATTACTTGCATTGGTATCAGCAGAAGCCAGGATTA CCCCCTAGACTCTTGATTTATAGGACATCCAATCTGGCTTCTGGAATC CCAGCTCGCTTCAGTGGCAGTGGGTCTGGGACCGATTTCACTCTCACA ATTAGCAGGCTGGAGCCTGAAGATGTTGCCGTTTACTACTGCCAGCAG GGTAGTAGTTTACCGTACACGTTCGGACAAGGGACCAAGCTTGAGATC AAA |
| 503. | PMH5D1 VH-VL × I2C VH-VL | artificial | aa | QVQLVQSGAEVKKPGASVKVSCKASGYNFKDTYMDWVKQTPEQGLEWM GRIDPANGDSKYDPKFQGRVTITADTSTNTAYMELSSLRSEDTAVYYC ARGGMIWYFDVWGQGTTVTVSSGGGGSGGGGSGGGGSEIVLTQSPATL SLSPGERATLSCSASSSISSNYLHWYQQKPGLPPRLLIYRTSNLASGI PARFSGSGSGTDFTLTISRLEPEDVAVYYCQQGSSLPYTFGQGTKLEI KSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA |

| SEQ ID NO. | DESIGNATION | SOURCE | TYPE | SEQUENCE |
|---|---|---|---|---|
| | | | | PRGLIGGTKFLAPGTPARFSGSLLGGKAALTLSGVQPEDEAEYYCVLW YSNRWVFGGGTKLTVL |
| 504. | PMH5D1 VH-VL × I2C VH-VL | artificial | nt | CAGGTGCAGCTGGTCCAGTCTGGGGCAGAGGTTAAGAAGCCAGGGGCC TCAGTCAAGGTGTCCTGCAAAGCTTCTGGCTACAACTTTAAAGACACC TATATGGACTGGGTGAAGCAGACGCCTGAACAGGGCCTGGAATGGATG GGAAGGATTGATCCTGCAATGGTGATAGTAAATATGACCCGAAATTC CAGGGCAGGGTCACTATAACAGCAGACACATCCACCAACACAGCCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCCTG TCTCTATCTCCCGGGGAGAGGGCCACTCTCTCCTGCAGTGCCAGCTCA AGTATAAGTTCCAATTACTTGCATTGGTATCAGCAGAAGCCAGGATTA CCCCCTAGACTCTTGATTTATAGGACATCCAATCTGGCTTCTGGAATC CCAGCTCGCTTCAGTGGCAGTGGGTCTGGGACCGATTTCACTCTCACA ATTAGCAGGCTGGAGCCTGAAGATGTTGCCGTTTACTACTGCCAGCAG GGTAGTAGTTTACCGTACACGTTCGGACAAGGGACCAAGCTTGAGATC AAATCCGGAGGTGTGGATCCGAGGTGCAGCTGGTCGAGTCTGGAGGA GGATTGGTGCAGCCTGGAGGGTCATTGAAACTCTCATGTGCAGCCTCT GGATTCACCTTCAATAAGTACGCCATGAACTGGGTCCGCCAGGCTCCA GGAAAGGGTTTGGAATGGGTTGCTCGCATAAGAAGTAAATATAATAAT TATGCAACATATTATGCCGATTCAGTGAAAGACAGGTTCACCATCTCC AGAGATGATTCAAAAAACACTGCCTATCTACAAATGAACAACTTGAAA ACTGAGGACACTGCCGTGTACTACTGTGTGAGACATGGGAACTTCGGT AATAGCTACATATCCTACTGGGCTTACTGGGGCCAAGGGACTCTGGTC ACCGTCTCCTCAGGTGGTGGTGGTTCTGGCGGCGGCGGCTCCGGTGGT GGTGGTTCTCAGACTGTTGTGACTCAGGAACCTTCACTCACCGTATCA CCTGGTGGAACAGTCACACTCACTTGTGGCTCCTCGACTGGGGCTGTT ACATCTGGCAACTACCCAAACTGGGTCCAACAAAAACCAGGTCAGGCA CCCCGTGGTCTAATAGGTGGGACTAAGTTCCTCGCCCCCGGTACTCCT GCCAGATTCTCAGGCTCCCTGCTTGGAGGCAAGGCTGCCCTCACCCTC TCAGGGGTACAGCCAGAGGATGAGGCAGAATATTACTGTGTTCTATGG TACAGCAACCGCTGGGTGTTCGGTGGAGGAACCAAACTGACTGTCCTA |
| 505. | PMH8D1-VH | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSS |
| 506. | PMH8D1-HCDR1 | artificial | aa | DTYMD |
| 507. | PMH8D1-HCDR2 | artificial | aa | RIDPANGDSKYDPKFQG |
| 508. | PMH8D1-HCDR3 | artificial | aa | GGMIWYFDV |
| 509. | PMH8D1-VH | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCA |
| 510. | PMH8D1-VL | artificial | aa | EIVLTQSPATLSLSPGERATLSCSASSSISSNYLHWYQQKPGLPPRLL IYRTSNLASGIPARFSGSGSGTDFTLTISRLEPEDVAVYYCQQGSSLP YTFGQGTKLEIK |
| 511. | PMH8D1-LCDR1 | artificial | aa | SASSSISSNYLH |
| 512. | PMH8D1-LCDR2 | artificial | aa | RTSNLAS |
| 513. | PMH8D1-LCDR3 | artificial | aa | QQGSSLPYT |
| 514. | PMH8D1-VL | artificial | nt | GAGATCGTGCTCACCCAGTCTCCAGCCACCCTGTCTCTATCTCCCGGG GAGAGGGCCACTCTCTCCTGCAGTGCCAGCTCAAGTATAAGTTCCAAT TACTTGCATTGGTATCAGCAGAAGCCAGGATTACCCCCTAGACTCTTG ATTTATAGGACATCCAATCTGGCTTCTGGAATCCCAGCTCGCTTCAGT GGCAGTGGGTCTGGGACCGATTTCACTCTCACAATTAGCAGGCTGGAG CCTGAAGATGTTGCCGTTTACTACTGCCAGCAGGGTAGTAGTTTACCG TACACGTTCGGACAAGGGACCAAGCTTGAGATCAAA |
| 515. | PMH8D1-VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATL SLSPGERATLSCSASSSISSNYLHWYQQKPGLPPRLLIYRTSNLASGI |

| SEQ ID NO. | DESIGNATION | SOURCE | TYPE | SEQUENCE |
|---|---|---|---|---|
| | | | | PARFSGSGSGTDFTLTISRLEPEDVAVYYCQQGSSLPYTFGQGTKLEIK |
| 516. | PMH8D1-VH-VL | artificial | nt | CAGGTGCAGCTGGTCCAGTCTGGGGCAGAGGTTGTGAAGCCAGGGGCCTCAGTCAAGTTGTCCTGCAAAGCTTCTGGCTTCACCATTACAGACACCTATATGGACTGGGTGAGGCAGGCGCCTGGACAGGGCCTGGAATGGATTGGAAGGATTGATCCTGCAAATGGTGATAGTAAATATGACCCGAAATTCCAGGGCAGGGCCACTATAACACCAGACACATCCACCAACACAGTCTACATGGAGCTCAGCAGCCTGAGATCTGAGGACACTGCCGTCTATTATTGTGCTAGAGGCGGGATGATATGGTACTTCGATGTCTGGGGCCAAGGGACCACGGTCACCGTCTCCTCAGGTGGTGGTGGTTCTGGCGGCGGCGGCTCCGGTGGTGGTGGTTCTGAGATCGTGCTCACCCAGTCTCCAGCCACCCTGTCTCTATCTCCCGGGGAGAGGGCCACTCTCTCCTGCAGTGCCAGCTCAAGTATAAGTTCCAATTACTTGCATTGGTATCAGCAGAAGCCAGGATTACCCCCTAGACTCTTGATTTATAGGACATCCAATCTGGCTTCTGGAATCCCAGCTCGCTTCAGTGGCAGTGGGTCTGGGACCGATTTCACTCTCACAATTAGCAGGCTGGAGCCTGAAGATGTTGCCGTTTACTACTGCCAGCAGGGTAGTAGTTTACCGTACACGTTCGGACAAGGGACCAAGCTTGAGATCAAA |
| 517. | PMH8D1 VH-VL × I2C VH-VL | artificial | aa | QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATLSLSPGERATLSCSASSSISSNYLHWYQQKPGLPPRLLIYRTSNLASGIPARFSGSGSGTDFTLTISRLEPEDVAVYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 518. | PMH8D1 VH-VL × I2C VH-VL | artificial | nt | CAGGTGCAGCTGGTCCAGTCTGGGGCAGAGGTTGTGAAGCCAGGGGCCTCAGTCAAGTTGTCCTGCAAAGCTTCTGGCTTCACCATTACAGACACCTATATGGACTGGGTGAGGCAGGCGCCTGGACAGGGCCTGGAATGGATTGGAAGGATTGATCCTGCAAATGGTGATAGTAAATATGACCCGAAATTCCAGGGCAGGGCCACTATAACACCAGACACATCCACCAACACAGTCTACATGGAGCTCAGCAGCCTGAGATCTGAGGACACTGCCGTCTATTATTGTGCTAGAGGCGGGATGATATGGTACTTCGATGTCTGGGGCCAAGGGACCACGGTCACCGTCTCCTCAGGTGGTGGTGGTTCTGGCGGCGGCGGCTCCGGTGGTGGTGGTTCTGAGATCGTGCTCACCCAGTCTCCAGCCACCCTGTCTCTATCTCCCGGGGAGAGGGCCACTCTCTCCTGCAGTGCCAGCTCAAGTATAAGTTCCAATTACTTGCATTGGTATCAGCAGAAGCCAGGATTACCCCCTAGACTCTTGATTTATAGGACATCCAATCTGGCTTCTGGAATCCCAGCTCGCTTCAGTGGCAGTGGGTCTGGGACCGATTTCACTCTCACAATTAGCAGGCTGGAGCCTGAAGATGTTGCCGTTTACTACTGCCAGCAGGGTAGTAGTTTACCGTACACGTTCGGACAAGGGACCAAGCTTGAGATCAAATCCGGAGGTGTGGATCCGAGGTGCAGCTGGTCGAGTCTGGAGGAGGATTGGTGCAGCCTGGAGGGTCATTGAAACTCTCATGTGCAGCCTCTGGATTCACCTTCAATAAGTACGCCATGAACTGGGTCCGCCAGGCTCCAGGAAAGGGTTTGGAATGGGTTGCTCGCATAAGAAGTAAATATAATAATTATGCAACATATTATGCCGATTCAGTGAAAGACAGGTTCACCATCTCCAGAGATGATTCAAAAAACACTGCCTATCTACAAATGAACAACTTGAAAACTGAGGACACTGCCGTGTACTACTGTGTGAGACATGGGAACTTCGGTAATAGCTACATATCCTACTGGGCTTACTGGGGCCAAGGGACTCTGGTCACCGTCTCCTCAGGTGGTGGTGGTTCTGGCGGCGGCGGCTCCGGTGGTGGTTCTCAGACTGTTGTGACTCAGGAACCTTCACTCACCGTATCACCTGGTGGAACAGTCACACTCACTTGTGGCTCCTCGACTGGGGCTGTTACATCTGGCAACTACCCAAACTGGGTCCAACAAAAACCAGGTCAGGCACCCCGTGGTCTAATAGGTGGGACTAAGTTCCTCGCCCCCGGTACTCCTGCCAGATTCTCAGGCTCCCTGCTTGGAGGCAAGGCTGCCCTCACCCTCTCAGGGGTACAGCCAGAGGATGAGGCAGAATATTACTGTGTTCTATGGTACAGCAACCGCTGGGTGTTCGGTGGAGGAACCAAACTGACTGTCCTA |
| 519. | PMH5E2-VH | artificial | aa | QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSS |
| 520. | PMH5E2-HCDR1 | artificial | aa | DTYMD |
| 521. | PMH5E2-HCDR2 | artificial | aa | RIDPANGDSKYDPKFQG |
| 522. | PMH5E2-HCDR3 | artificial | aa | GGMIWYFDV |
| 523. | PMH5E2-VH | artificial | nt | CAGGTGCAGCTGGTCCAGTCTGGGGCAGAGGTTAAGAAGCCAGGGGCCTCAGTCAAGGTGTCCTGCAAAGCTTCTGGCTACAACTTTAAAGACACCTATATGGACTGGGTGAAGCAGACGCCTGAACAGGGCCTGGAATGGATG |

| SEQ ID NO. | DESIGNATION | SOURCE | TYPE | SEQUENCE |
|---|---|---|---|---|
| | | | | GGAAGGATTGATCCTGCGAATGGTGATAGTAAATATGACCCGAAATTC<br>CAGGGCAGGGTCACTATAACAGCAGACACATCCACCAACACAGCCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCA |
| 524. | PMH5E2-VL | artificial | aa | EIVLTQSPATMSVSPGERATLSCSASSSISSNYLHWYQQKPGLPPRLL<br>IYRTSNLASGIPDRFSGSGSGTDFTLTISRLEAEDFATYYCQQGSSLP<br>YTFGQGTKLEIK |
| 525. | PMH5E2-LCDR1 | artificial | aa | SASSSISSNYLH |
| 526. | PMH5E2-LCDR2 | artificial | aa | RTSNLAS |
| 527. | PMH5E2-LCDR3 | artificial | aa | QQGSSLPYT |
| 528. | PMH5E2-VL | artificial | nt | GAGATCGTGCTCACCCAGTCTCCAGCCACCATGTCTGTATCTCCCGGG<br>GAGAGGGCCACTCTCTCCTGCAGTGCCAGCTCAAGTATAAGTTCCAAT<br>TACTTGCATTGGTATCAGCAGAAGCCAGGATTGCCCCCTAGACTCTTG<br>ATTTATAGGACATCCAATCTGGCTTCTGGAATCCCAGATCGCTTCAGT<br>GGCAGTGGGTCTGGGACCGATTTCACTCTCACAATTAGCAGGCTGGAG<br>GCTGAAGATTTTGCCACTTACTACTGCCAGCAGGGTAGTAGTTTACCG<br>TACACGTTCGGACAAGGGACCAAGCTTGAGATCAAA |
| 529. | PMH5E2-VH-VL | artificial | aa | QVQLVQSGAEVKKPGASVKVSCKASGYNFKDTYMDWVKQTPEQGLEWM<br>GRIDPANGDSKYDPKFQGRVTITADTSTNTAYMELSSLRSEDTAVYYC<br>ARGGMIWYFDVWGQGTTVTVSSGGGGSGGGGSGGGGSEIVLTQSPATM<br>SVSPGERATLSCSASSSISSNYLHWYQQKPGLPPRLLIYRTSNLASGI<br>PDRFSGSGSGTDFTLTISRLEAEDFATYYCQQGSSLPYTFGQGTKLEI<br>K |
| 530. | PMH5E2-VH-VL | artificial | nt | CAGGTGCAGCTGGTCCAGTCTGGGGCAGAGGTTAAGAAGCCAGGGGCC<br>TCAGTCAAGGTGTCCTGCAAAGCTTCTGGCTACAACTTTAAAGACACC<br>TATATGGACTGGGTGAAGCAGACGCCTGAACAGGGCCTGGAATGGATG<br>GGAAGGATTGATCCTGCGAATGGTGATAGTAAATATGACCCGAAATTC<br>CAGGGCAGGGTCACTATAACAGCAGACACATCCACCAACACAGCCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCAGGTGGTGGTGGTTCTGGCGGCGGCGGCTCC<br>GGTGGTGGTGGTTCTGAGATCGTGCTCACCCAGTCTCCAGCCACCATG<br>TCTGTATCTCCCGGGGAGAGGGCCACTCTCTCCTGCAGTGCCAGCTCA<br>AGTATAAGTTCCAATTACTTGCATTGGTATCAGCAGAAGCCAGGATTG<br>CCCCCTAGACTCTTGATTTATAGGACATCCAATCTGGCTTCTGGAATC<br>CCAGATCGCTTCAGTGGCAGTGGGTCTGGGACCGATTTCACTCTCACA<br>ATTAGCAGGCTGGAGGCTGAAGATTTTGCCACTTACTACTGCCAGCAG<br>GGTAGTAGTTTACCGTACACGTTCGGACAAGGGACCAAGCTTGAGATC<br>AAA |
| 531. | PMH5E2 VH-VL × I2C VH-VL | artificial | aa | QVQLVQSGAEVKKPGASVKVSCKASGYNFKDTYMDWVKQTPEQGLEWM<br>GRIDPANGDSKYDPKFQGRVTITADTSTNTAYMELSSLRSEDTAVYYC<br>ARGGMIWYFDVWGQGTTVTVSSGGGGSGGGGSGGGGSEIVLTQSPATM<br>SVSPGERATLSCSASSSISSNYLHWYQQKPGLPPRLLIYRTSNLASGI<br>PDRFSGSGSGTDFTLTISRLEAEDFATYYCQQGSSLPYTFGQGTKLEI<br>KSGGGGSEVQLVESGGGLVQPGGSLKLSCAASGFTFNKYAMNWVRQAP<br>GKGLEWVARIRSKYNNYATYYADSVKDRFTISRDDSKNTAYLQMNNLK<br>TEDTAVYYCVRHGNFGNSYISYWAYWGQGTLVTVSSGGGGSGGGGSGG<br>GGSQTVVTQEPSLTVSPGGTVTLTCGSSTGAVTSGNYPNWVQQKPGQA<br>PRGLIGGTKFLAPGTPARFSGSLLGGKAALTLSGVQPEDEAEYYCVLW<br>YSNRWVFGGGTKLTVL |
| 532. | PMH5E2 VH-VL × I2C VH-VL | artificial | nt | CAGGTGCAGCTGGTCCAGTCTGGGGCAGAGGTTAAGAAGCCAGGGGCC<br>TCAGTCAAGGTGTCCTGCAAAGCTTCTGGCTACAACTTTAAAGACACC<br>TATATGGACTGGGTGAAGCAGACGCCTGAACAGGGCCTGGAATGGATG<br>GGAAGGATTGATCCTGCGAATGGTGATAGTAAATATGACCCGAAATTC<br>CAGGGCAGGGTCACTATAACAGCAGACACATCCACCAACACAGCCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCAGGTGGTGGTGGTTCTGGCGGCGGCGGCTCC<br>GGTGGTGGTGGTTCTGAGATCGTGCTCACCCAGTCTCCAGCCACCATG<br>TCTGTATCTCCCGGGGAGAGGGCCACTCTCTCCTGCAGTGCCAGCTCA<br>AGTATAAGTTCCAATTACTTGCATTGGTATCAGCAGAAGCCAGGATTG<br>CCCCCTAGACTCTTGATTTATAGGACATCCAATCTGGCTTCTGGAATC<br>CCAGATCGCTTCAGTGGCAGTGGGTCTGGGACCGATTTCACTCTCACA<br>ATTAGCAGGCTGGAGGCTGAAGATTTTGCCACTTACTACTGCCAGCAG<br>GGTAGTAGTTTACCGTACACGTTCGGACAAGGGACCAAGCTTGAGATC<br>AAATCCGGAGGTGTGGATCCGAGGTGCAGCTGGTCGAGTCTGGAGGA<br>GGATTGGTGCAGCCTGGAGGGTCATTGAAACTCTCATGTGCAGCCTCT |

-continued

| SEQ ID NO. | DESIGNATION | SOURCE | TYPE | SEQUENCE |
|---|---|---|---|---|
| | | | | GGATTCACCTTCAATAAGTACGCCATGAACTGGGTCCGCCAGGCTCCA
GGAAAGGGTTTGGAATGGGTTGCTCGCATAAGAAGTAAATATAATAAT
TATGCAACATATTATGCCGATTCAGTGAAAGACAGGTTCACCATCTCC
AGAGATGATTCAAAAAACACTGCCTATCTACAAATGAACAACTTGAAA
ACTGAGGACACTGCCGTGTACTACTGTGTGAGACATGGGAACTTCGGT
AATAGCTACATATCCTACTGGGCTTACTGGGGCCAAGGGACTCTGGTC
ACCGTCTCCTCAGGTGGTGGTGGTTCTGGCGGCGGCGGCTCCGGTGGT
GGTGGTTCTCAGACTGTTGTGACTCAGGAACCTTCACTCACCGTATCA
CCTGGTGGAACAGTCACACTCACTTGTGGCTCCTCGACTGGGGCTGTT
ACATCTGGCAACTACCCAAACTGGGTCCAACAAAAACCAGGTCAGGCA
CCCCGTGGTCTAATAGGTGGGACTAAGTTCCTCGCCCCGGTACTCCT
GCCAGATTCTCAGGCTCCCTGCTTGGAGGCAAGGCTGCCCTCACCCTC
TCAGGGGTACAGCCAGAGGATGAGGCAGAATATTACTGTGTTCTATGG
TACAGCAACCGCTGGGTGTTCGGTGGAGGAACCAAACTGACTGTCCTA |
| 533. | PMH8E2-VH | artificial | aa | QVQLVQSGAEVVKPGASVKLSCKASGFTITDTYMDWVRQAPGQGLEWI
GRIDPANGDSKYDPKFQGRATITPDTSTNTVYMELSSLRSEDTAVYYC
ARGGMIWYFDVWGQGTTVTVSS |
| 534. | PMH8E2-HCDR1 | artificial | aa | DTYMD |
| 535. | PMH8E2-HCDR2 | artificial | aa | RIDPANGDSKYDPKFQG |
| 536. | PMH8E2-HCDR3 | artificial | aa | GGMIWYFDV |
| 537. | PMH8E2-VH | artificial | nt | CAGGTGCAGCTGGTCCAGTCTGGGGCAGAGGTTGTGAAGCCAGGGGCC
TCAGTCAAGTTGTCCTGCAAAGCTTCTGGCTTCACCATTACAGACACC
TATATGGACTGGGTGAGGCAGGCGCCTGGACAGGGCCTGGAATGGATT
GGAAGGATTGATCCTGCGAATGGTGATAGTAAATATGACCCGAAATTC
CAGGGCAGGGCCACTATAACACCAGACACATCCACCAACACAGTCTAC
ATGGAGCTCAGCAGCCTGAGATCTGAGGACACTGCCGTCTATTATTGT
GCTAGAGGCGGGATGATATGGTACTTCGATGTCTGGGGCCAAGGGACC
ACGGTCACCGTCTCCTCA |
| 538. | PMH8E2-VL | artificial | aa | EIVLTQSPATMSVSPGERATLSCSASSSISSNYLHWYQQKPGLPPRLL
IYRTSNLASGIPDRFSGSGSGTDFTLTISRLEAEDFATYYCQQGSSLP
YTFGQGTKLEIK |
| 539. | PMH8E2-LCDR1 | artificial | aa | SASSSISSNYLH |
| 540. | PMH8E2-LCDR2 | artificial | aa | RTSNLAS |
| 541. | PMH8E2-LCDR3 | artificial | aa | QQGSSLPYT |
| 542. | PMH8E2-VL | artificial | nt | GAGATCGTGCTCACCCAGTCTCCAGCCACCATGTCTGTATCTCCCGGG
GAGAGGGCCACTCTCTCCTGCAGTGCCAGCTCAAGTATAAGTTCCAAT
TACTTGCATTGGTATCAGCAGAAGCCAGGATTGCCCCCTAGACTCTTG
ATTTATAGGACATCCAATCTGGCTTCTGGAATCCCAGATCGCTTCAGT
GGCAGTGGGTCTGGGACCGATTTCACTCTCACAATTAGCAGGCTGGAG
GCTGAAGATTTTGCCACTTACTACTGCCAGCAGGGTAGTAGTTTACCG
TACACGTTCGGACAAGGGACCAAGCTTGAGATCAAA |
| 543. | PMH8E2-VH-VL | artificial | aa | QVQLVQSGAEVVKPGASVKLSCKASGFTITDTYMDWVRQAPGQGLEWI
GRIDPANGDSKYDPKFQGRATITPDTSTNTVYMELSSLRSEDTAVYYC
ARGGMIWYFDVWGQGTTVTVSSGGGGSGGGGSGGGGSEIVLTQSPATM
SVSPGERATLSCSASSSISSNYLHWYQQKPGLPPRLLIYRTSNLASGI
PDRFSGSGSGTDFTLTISRLEAEDFATYYCQQGSSLPYTFGQGTKLEI
K |
| 544. | PMH8E2-VH-VL | artificial | nt | CAGGTGCAGCTGGTCCAGTCTGGGGCAGAGGTTGTGAAGCCAGGGGCC
TCAGTCAAGTTGTCCTGCAAAGCTTCTGGCTTCACCATTACAGACACC
TATATGGACTGGGTGAGGCAGGCGCCTGGACAGGGCCTGGAATGGATT
GGAAGGATTGATCCTGCGAATGGTGATAGTAAATATGACCCGAAATTC
CAGGGCAGGGCCACTATAACACCAGACACATCCACCAACACAGTCTAC
ATGGAGCTCAGCAGCCTGAGATCTGAGGACACTGCCGTCTATTATTGT
GCTAGAGGCGGGATGATATGGTACTTCGATGTCTGGGGCCAAGGGACC
ACGGTCACCGTCTCCTCAGGTGGTGGTGGTTCTGGCGGCGGCGGCTCC
GGTGGTGGTGGTTCTGAGATCGTGCTCACCCAGTCTCCAGCCACCATG
TCTGTATCTCCCGGGGAGAGGGCCACTCTCTCCTGCAGTGCCAGCTCA
AGTATAAGTTCCAATTACTTGCATTGGTATCAGCAGAAGCCAGGATTG
CCCCCTAGACTCTTGATTTATAGGACATCCAATCTGGCTTCTGGAATC
CCAGATCGCTTCAGTGGCAGTGGGTCTGGGACCGATTTCACTCTCACA
ATTAGCAGGCTGGAGGCTGAAGATTTTGCCACTTACTACTGCCAGCAG
GGTAGTAGTTTACCGTACACGTTCGGACAAGGGACCAAGCTTGAGATC
AAA |

| SEQ ID NO. | DESIGNATION | SOURCE | TYPE | SEQUENCE |
|---|---|---|---|---|
| 545. | PMH8E2 VH-VL × I2C VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATM SVSPGERATLSCSASSSISSNYLHWYQQKPGLPPRLLIYRTSNLASGI PDRFSGSGSGTDFTLTISRLEAEDFATYYCQQGSSLPYTFGQGTKLEI KSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVL |
| 546. | PMH8E2 VH-VL × I2C VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCATG TCTGTATCTCCCGGGGAGAGGGCCACTCTCTCCTGCAGTGCCAGCTCA AGTATAAGTTCCAATTACTTGCATTGGTATCAGCAGAAGCCAGGATTG CCCCCTAGACTCTTGATTTATAGGACATCCAATCTGGCTTCTGGAATC CCAGATCGCTTCAGTGGCAGTGGGTCTGGGACCGATTTCACTCTCACA ATTAGCAGGCTGGAGGCTGAAGATTTTGCCACTTACTACTGCCAGCAG GGTAGTAGTTTACCGTACACGTTCGGACAAGGGACCAAGCTTGAGATC AAATCCGGAGGTGGTGGATCCGAGGTGCAGCTGGTCGAGTCTGGAGGA GGATTGGTGCAGCCTGGAGGGTCATTGAAACTCTCATGTGCAGCCTCT GGATTCACCTTCAATAAGTACGCCATGAACTGGGTCCGCCAGGCTCCA GGAAAGGGTTTGGAATGGGTTGCTCGCATAAGAAGTAAATATAATAAT TATGCAACATATTATGCCGATTCAGTGAAAGACAGGTTCACCATCTCC AGAGATGATTCAAAAAACACTGCCTATCTACAAATGAACAACTTGAAA ACTGAGGACACTGCCGTGTACTACTGTGTGAGACATGGGAACTTCGGT AATAGCTACATATCCTACTGGGCTTACTGGGGCCAAGGGACTCTGGTC ACCGTCTCCTCAGGTGGTGGTGGTTCTGGCGGCGGCGGCTCCGGTGGT GGTGGTTCTCAGACTGTTGTGACTCAGGAACCTTCACTCACCGTATCA CCTGGTGGAACAGTCACACTCACTTGTGGCTCCTCGACTGGGGCTGTT ACATCTGGCAACTACCCAAACTGGGTCCAACAAAAACCAGGTCAGGCA CCCCGTGGTCTAATAGGTGGGACTAAGTTCCTCGCCCCCGGTACTCCT GCCAGATTCTCAGGCTCCCTGCTTGGAGGCAAGGCTGCCCTCACCCTC TCAGGGGTACAGCCAGAGGATGAGGCAGAATATTACTGTGTTCTATGG TACAGCAACCGCTGGGTGTTCGGTGGAGGAACCAAACTGACTGTCCTA |
| 547. | PMH8E4-VH | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSS |
| 548. | PMH8E4-HCDR1 | artificial | aa | DTYMD |
| 549. | PMH8E4-HCDR2 | artificial | aa | RIDPANGDSKYDPKFQG |
| 550. | PMH8E4-HCDR3 | artificial | aa | GGMIWYFDV |
| 551. | PMH8E4-VH | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCA |
| 552. | PMH8E4-VL | artificial | aa | EIVLTQSPATLSLSPGERATLSCSASSSISSNYLHWYQQKPGLPPRLL IYRTSNLASGIPDRFSGSGSGTDYTLTISRLEPEDFATYYCQQGSSLP YTFGQGTKLEIK |
| 553. | PMH8E4-LCDR1 | artificial | aa | SASSSISSNYLH |
| 554. | PMH8E4-LCDR2 | artificial | aa | RTSNLAS |
| 555. | PMH8E4-LCDR3 | artificial | aa | QQGSSLPYT |
| 556. | PMH8E4-VL | artificial | nt | GAGATCGTGCTCACCCAGTCTCCAGCCACCCTGTCTCTATCTCCCGGG GAGAGGGCCACTCTCTCCTGCAGTGCCAGCTCAAGTATAAGTTCCAAT TACTTGCATTGGTATCAGCAGAAGCCAGGATTGCCCCCTAGACTCTTG |

| SEQ ID NO. | DESIGNATION | SOURCE | TYPE | SEQUENCE |
|---|---|---|---|---|
| | | | | ATTTATAGGACATCCAATCTGGCTTCTGGAATCCCAGATCGCTTCAGT GGCAGTGGGTCTGGGACCGATTACACTCTCACAATTAGCAGGCTGGAG CCTGAAGATTTTGCCACTTACTACTGCCAGCAGGGTAGTAGTTTACCG TACACGTTCGGACAAGGGACCAAGCTTGAGATCAAA |
| 557. | PMH8E4-VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATL SLSPGERATLSCSASSSISSNYLHWYQQKPGLPPRLLIYRTSNLASGI PDRFSGSGSGTDYTLTISRLEPEDFATYYCQQGSSLPYTFGQGTKLEI K |
| 558. | PMH8E4-VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCCTG TCTCTATCTCCCGGGGAGAGGGCCACTCTCTCCTGCAGTGCCAGCTCA AGTATAAGTTCCAATTACTTGCATTGGTATCAGCAGAAGCCAGGATTG CCCCCTAGACTCTTGATTTATAGGACATCCAATCTGGCTTCTGGAATC CCAGATCGCTTCAGTGGCAGTGGGTCTGGGACCGATTACACTCTCACA ATTAGCAGGCTGGAGCCTGAAGATTTTGCCACTTACTACTGCCAGCAG GGTAGTAGTTTACCGTACACGTTCGGACAAGGGACCAAGCTTGAGATC AAA |
| 559. | PMH8E4 VH-VL x I2C VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATL SLSPGERATLSCSASSSISSNYLHWYQQKPGLPPRLLIYRTSNLASGI PDRFSGSGSGTDYTLTISRLEPEDFATYYCQQGSSLPYTFGQGTKLEI KSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVL |
| 560. | PMH8E4 VH-VL x I2C VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCCTG TCTCTATCTCCCGGGGAGAGGGCCACTCTCTCCTGCAGTGCCAGCTCA AGTATAAGTTCCAATTACTTGCATTGGTATCAGCAGAAGCCAGGATTG CCCCCTAGACTCTTGATTTATAGGACATCCAATCTGGCTTCTGGAATC CCAGATCGCTTCAGTGGCAGTGGGTCTGGGACCGATTACACTCTCACA ATTAGCAGGCTGGAGCCTGAAGATTTTGCCACTTACTACTGCCAGCAG GGTAGTAGTTTACCGTACACGTTCGGACAAGGGACCAAGCTTGAGATC AAATCCGGAGGTGGTGGATCCGAGGTGCAGCTGGTCGAGTCTGGAGGA GGATTGGTGCAGCCTGGAGGGTCATTGAAACTCTCATGTGCAGCCTCT GGATTCACCTTCAATAAGTACGCCATGAACTGGGTCCGCCAGGCTCCA GGAAAGGGTTTGGAATGGGTTGCTCGCATAAGAAGTAAATATAATAAT TATGCAACATATTATGCCGATTCAGTGAAAGACAGGTTCACCATCTCC AGAGATGATTCAAAAAACACTGCCTATCTACAAATGAACAACTTGAAA ACTGAGGACACTGCCGTGTACTACTGTGTGAGACATGGGAACTTCGGT AATAGCTACATATCCTACTGGGCTTACTGGGGCCAAGGGACTCTGGTC ACCGTCTCCTCAGGTGGTGGTGGTTCTGGCGGCGGCGGCTCCGGTGGT GGTGGTTCTCAGACTGTTGTGACTCAGGAACCTTCACTCACCGTATCA CCTGGTGGAACAGTCACACTCACTTGTGGCTCCTCGACTGGGGCTGTT ACATCTGGCAACTACCCAAACTGGGTCCAACAAAAACCAGGTCAGGCA CCCCGTGGTCTAATAGGTGGGACTAAGTTCCTCGCCCCCGGTACTCCT GCCAGATTCTCAGGCTCCCTGCTTGGAGGCAAGGCTGCCCTCACCCTC TCAGGGGTACAGCCAGAGGATGAGGCAGAATATTACTGTGTTCTATGG TACAGCAACCGCTGGGTGTTCGGTGGAGGAACCAAACTGACTGTCCTA |
| 561. | PMH8G6-VH | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSS |

-continued

| SEQ ID NO. | DESIGNATION | SOURCE | TYPE | SEQUENCE |
|---|---|---|---|---|
| 562. | PMH8G6-HCDR1 | artificial | aa | DTYMD |
| 563. | PMH8G6-HCDR2 | artificial | aa | RIDPANGDSKYDPKFQG |
| 564. | PMH8G6-HCDR3 | artificial | aa | GGMIWYFDV |
| 565. | PMH8G6-VH | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCA |
| 566. | PMH8G6-VL | artificial | aa | EIVLTQSPATMSLSPGERATISCSASSSISSNYLHWYQQKPGLPPKLL IYRTSNLASGIPDRFSGSGSGTDFTLTISRMEPEDFAVYYCQQGSSLP YTFGQGTKLEIK |
| 567. | PMH8G6-LCDR1 | artificial | aa | SASSSISSNYLH |
| 568. | PMH8G6-LCDR2 | artificial | aa | RTSNLAS |
| 569. | PMH8G6-LCDR3 | artificial | aa | QQGSSLPYT |
| 570. | PMH8G6-VL | artificial | nt | GAGATCGTGCTCACCCAGTCTCCAGCCACCATGTCTCTATCTCCCGGG GAGAGGGCCACTATCTCCTGCAGTGCCAGCTCAAGTATAAGTTCCAAT TACTTGCATTGGTATCAGCAGAAGCCAGGATTGCCCCCTAAACTCTTG ATTTATAGGACATCCAATCTGGCTTCTGGAATCCCAGATCGCTTCAGT GGCAGTGGGTCTGGGACCGATTTCACTCTCACAATTAGCAGGATGGAG CCTGAAGATTTTGCCGTTTACTACTGCCAGCAGGGTAGTAGTTTACCG TACACGTTCGGACAAGGGACCAAGCTTGAGATCAAA |
| 571. | PMH8G6-VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATM SLSPGERATISCSASSSISSNYLHWYQQKPGLPPKLLIYRTSNLASGI PDRFSGSGSGTDFTLTISRMEPEDFAVYYCQQGSSLPYTFGQGTKLEI K |
| 572. | PMH8G6-VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCATG TCTCTATCTCCCGGGGAGAGGGCCACTATCTCCTGCAGTGCCAGCTCA AGTATAAGTTCCAATTACTTGCATTGGTATCAGCAGAAGCCAGGATTG CCCCCTAAACTCTTGATTTATAGGACATCCAATCTGGCTTCTGGAATC CCAGATCGCTTCAGTGGCAGTGGGTCTGGGACCGATTTCACTCTCACA ATTAGCAGGATGGAGCCTGAAGATTTTGCCGTTTACTACTGCCAGCAG GGTAGTAGTTTACCGTACACGTTCGGACAAGGGACCAAGCTTGAGATC AAA |
| 573. | PMH8G6 VH-VL x I2C VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATM SLSPGERATISCSASSSISSNYLHWYQQKPGLPPKLLIYRTSNLASGI PDRFSGSGSGTDFTLTISRMEPEDFAVYYCQQGSSLPYTFGQGTKLEI KSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVL |
| 574. | PMH8G6 VH-VL x I2C VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC |

| SEQ ID NO. | DESIGNATION | SOURCE | TYPE | SEQUENCE |
|---|---|---|---|---|
| | | | | ACGGTCACCGTCTCCTCAGGTGGTGGTGGTTCTGGCGGCGGCGGCTCC<br>GGTGGTGGTGGTTCTGAGATCGTGCTCACCCAGTCTCCAGCCACCATG<br>TCTCTATCTCCCGGGGAGAGGGCCACTATCTCCTGCAGTGCCAGCTCA<br>AGTATAAGTTCCAATTACTTGCATTGGTATCAGCAGAAGCCAGGATTG<br>CCCCCTAAACTCTTGATTTATAGGACATCCAATCTGGCTTCTGGAATC<br>CCAGATCGCTTCAGTGGCAGTGGGTCTGGGACCGATTTCACTCTCACA<br>ATTAGCAGGATGGAGCCTGAAGATTTTGCCGTTTACTACTGCCAGCAG<br>GGTAGTAGTTTACCGTACACGTTCGGACAAGGGACCAAGCTTGAGATC<br>AAATCCGGAGGTGGTGGATCCGAGGTGCAGCTGGTCGAGTCTGGAGGA<br>GGATTGGTGCAGCCTGGAGGGTCATTGAAACTCTCATGTGCAGCCTCT<br>GGATTCACCTTCAATAAGTACGCCATGAACTGGGTCCGCCAGGCTCCA<br>GGAAAGGGTTTGGAATGGGTTGCTCGCATAAGAAGTAAATATAATAAT<br>TATGCAACATATTATGCCGATTCAGTGAAAGACAGGTTCACCATCTCC<br>AGAGATGATTCAAAAAACACTGCCTATCTACAAATGAACAACTTGAAA<br>ACTGAGGACACTGCCGTGTACTACTGTGTGAGACATGGGAACTTCGGT<br>AATAGCTACATATCCTACTGGGCTTACTGGGGCCAAGGGACTCTGGTC<br>ACCGTCTCCTCAGGTGGTGGTGGTTCTGGCGGCGGCGGCTCCGGTGGT<br>GGTGGTTCTCAGACTGTTGTGACTCAGGAACCTTCACTCACCGTATCA<br>CCTGGTGGAACAGTCACACTCACTTGTGGCTCCTCGACTGGGGCTGTT<br>ACATCTGGCAACTACCCAAACTGGGTCCAACAAAAACCAGGTCAGGCA<br>CCCCGTGGTCTAATAGGTGGGACTAAGTTCCTCGCCCCCGGTACTCCT<br>GCCAGATTCTCAGGCTCCCTGCTTGGAGGCAAGGCTGCCCTCACCCTC<br>TCAGGGGTACAGCCAGAGGATGAGGCAGAATATTACTGTGTTCTATGG<br>TACAGCAACCGCTGGGTGTTCGGTGGAGGAACCAAACTGACTGTCCTA |
| 575. | PMH5H2-VH | artificial | aa | QVQLVQSGAEVKKPGASVKVSCKASGYNFKDTYMDWVKQTPEQGLEWM<br>GRIDPANGDSKYDPKFQGRVTITADTSTNTAYMELSSLRSEDTAVYYC<br>ARGGMIWYFDVWGQGTTVTVSS |
| 576. | PMH5H2-HCDR1 | artificial | aa | DTYMD |
| 577. | PMH5H2-HCDR2 | artificial | aa | RIDPANGDSKYDPKFQG |
| 578. | PMH5H2-HCDR3 | artificial | aa | GGMIWYFDV |
| 579. | PMH5H2-VH | artificial | nt | CAGGTGCAGCTGGTCCAGTCTGGGGCAGAGGTTAAGAAGCCAGGGGCC<br>TCAGTCAAGGTGTCCTGCAAAGCTTCTGGCTACAACTTTAAAGACACC<br>TATATGGACTGGGTGAAGCAGACGCCTGAACAGGGCCTGGAATGGATG<br>GGAAGGATTGATCCTGCGAATGGTGATAGTAAATATGACCCGAAATTC<br>CAGGGCAGGGTCACTATAACAGCAGACACATCCACCAACACAGCCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCA |
| 580. | PMH5H2-VL | artificial | aa | EIVLTQSPATMALSPGERATLSCSASSSISSNYLHWYQQKPGLPPRLL<br>IYRTSNLASGIPDRFSGSGSGTDFTLTISRLEPEDVAVYYCQQGSSLP<br>YTFGQGTKLEIK |
| 581. | PMH5H2-LCDR1 | artificial | aa | SASSSISSNYLH |
| 582. | PMH5H2-LCDR2 | artificial | aa | RTSNLAS |
| 583. | PMH5H2-LCDR3 | artificial | aa | QQGSSLPYT |
| 584. | PMH5H2-VL | artificial | nt | GAGATCGTGCTCACCCAGTCTCCAGCCACCATGGCTCTATCTCCCGGG<br>GAGAGGGCCACTCTCTCCTGCAGTGCCAGCTCAAGTATAAGTTCCAAT<br>TACTTGCATTGGTATCAGCAGAAGCCAGGATTGCCCCCTAGACTCTTG<br>ATTTATAGGACATCCAATCTGGCTTCTGGAATCCCAGATCGCTTCAGT<br>GGCAGTGGGTCTGGGACCGATTTCACTCTCACAATTAGCAGGCTGGAG<br>CCTGAAGATGTTGCCGTTTACTACTGCCAGCAGGGTAGTAGTTTACCG<br>TACACGTTCGGACAAGGGACCAAGCTTGAGATCAAA |
| 585. | PMH5H2-VH-VL | artificial | aa | QVQLVQSGAEVKKPGASVKVSCKASGYNFKDTYMDWVKQTPEQGLEWM<br>GRIDPANGDSKYDPKFQGRVTITADTSTNTAYMELSSLRSEDTAVYYC<br>ARGGMIWYFDVWGQGTTVTVSSGGGGSGGGGSGGGGSEIVLTQSPATM<br>ALSPGERATLSCSASSSISSNYLHWYQQKPGLPPRLLIYRTSNLASGI<br>PDRFSGSGSGTDFTLTISRLEPEDVAVYYCQQGSSLPYTFGQGTKLEI<br>K |
| 586. | PMH5H2-VH-VL | artificial | nt | CAGGTGCAGCTGGTCCAGTCTGGGGCAGAGGTTAAGAAGCCAGGGGCC<br>TCAGTCAAGGTGTCCTGCAAAGCTTCTGGCTACAACTTTAAAGACACC<br>TATATGGACTGGGTGAAGCAGACGCCTGAACAGGGCCTGGAATGGATG<br>GGAAGGATTGATCCTGCGAATGGTGATAGTAAATATGACCCGAAATTC<br>CAGGGCAGGGTCACTATAACAGCAGACACATCCACCAACACAGCCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCAGGTGGTGGTGGTTCTGGCGGCGGCGGCTCC |

| SEQ ID NO. | DESIGNATION | SOURCE | TYPE | SEQUENCE |
|---|---|---|---|---|
| | | | | GGTGGTGGTGGTTCTGAGATCGTGCTCACCCAGTCTCCAGCCACCATG<br>GCTCTATCTCCCGGGGAGAGGGCCACTCTCTCCTGCAGTGCCAGCTCA<br>AGTATAAGTTCCAATTACTTGCATTGGTATCAGCAGAAGCCAGGATTG<br>CCCCCTAGACTCTTGATTTATAGGACATCCAATCGGCTTCTGGAATC<br>CCAGATCGCTTCAGTGGCAGTGGGTCTGGGACCGATTTCACTCTCACA<br>ATTAGCAGGCTGGAGCCTGAAGATGTTGCCGTTTACTACTGCCAGCAG<br>GGTAGTAGTTTACCGTACACGTTCGGACAAGGGACCAAGCTTGAGATC<br>AAA |
| 587. | PMH5H2 VH-VL × I2C VH-VL | artificial | aa | QVQLVQSGAEVKKPGASVKVSCKASGYNFKDTYMDWVKQTPEQGLEWM<br>GRIDPANGDSKYDPKFQGRVTITADTSTNTAYMELSSLRSEDTAVYYC<br>ARGGMIWYFDVWGQGTTVTVSSGGGGSGGGGSGGGGSEIVLTQSPATM<br>ALSPGERATLSCSASSSISSNYLHWYQQKPGLPPRLLIYRTSNLASGI<br>PDRFSGSGSGTDFTLTISRLEPEDVAVYYCQQGSSLPYTFGQGTKLEI<br>KSGGGGSEVQLVESGGGLVQPGGSLKLSCAASGFTFNKYAMNWVRQAP<br>GKGLEWVARIRSKYNNYATYYADSVKDRFTISRDDSKNTAYLQMNNLK<br>TEDTAVYYCVRHGNFGNSYISYWAYWGQGTLVTVSSGGGGSGGGGSGG<br>GGSQTVVTQEPSLTVSPGGTVTLTCGSSTGAVTSGNYPNWVQQKPGQA<br>PRGLIGGTKFLAPGTPARFSGSLLGGKAALTLSGVQPEDEAEYYCVLW<br>YSNRWVFGGGTKLTVL |
| 588. | PMH5H2 VH-VL × I2C VH-VL | artificial | nt | CAGGTGCAGCTGGTCCAGTCTGGGGCAGAGGTTAAGAAGCCAGGGGCC<br>TCAGTCAAGGTGTCCTGCAAAGCTTCTGGCTACAACTTTAAAGACACC<br>TATATGGACTGGGTGAAGCAGACGCCTGAACAGGGCCTGGAATGGATG<br>GGAAGGATTGATCCTGCGAATGGTGATAGTAAATATGACCCGAAATTC<br>CAGGGCAGGGTCACTATAACAGCAGACACATCCACCAACACAGCCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCAGGTGGTGGTGGTTCTGGCGGCGGCGGCTCC<br>GGTGGTGGTGGTTCTGAGATCGTGCTCACCCAGTCTCCAGCCACCATG<br>GCTCTATCTCCCGGGGAGAGGGCCACTCTCTCCTGCAGTGCCAGCTCA<br>AGTATAAGTTCCAATTACTTGCATTGGTATCAGCAGAAGCCAGGATTG<br>CCCCCTAGACTCTTGATTTATAGGACATCCAATCGGCTTCTGGAATC<br>CCAGATCGCTTCAGTGGCAGTGGGTCTGGGACCGATTTCACTCTCACA<br>ATTAGCAGGCTGGAGCCTGAAGATGTTGCCGTTTACTACTGCCAGCAG<br>GGTAGTAGTTTACCGTACACGTTCGGACAAGGGACCAAGCTTGAGATC<br>AAATCCGGAGGTGTGGATCCGAGGTGCAGCTGGTCGAGTCTGGAGGA<br>GGATTGGTGCAGCCTGGAGGGTCATTGAAACTCTCATGTGCAGCCTCT<br>GGATTCACCTTCAATAAGTACGCCATGAACTGGGTCCGCCAGGCTCCA<br>GGAAAGGGTTTGGAATGGGTTGCTCGCATAAGAAGTAAATATAATAAT<br>TATGCAACATATTATGCCGATTCAGTGAAAGACAGGTTCACCATCTCC<br>AGAGATGATTCAAAAAACACTGCCTATCTACAAATGAACAACTTGAAA<br>ACTGAGGACACTGCCGTGTACTACTGTGTGAGACATGGGAACTTCGGT<br>AATAGCTACATATCCTACTGGGCTTACTGGGGCCAAGGGACTCTGGTC<br>ACCGTCTCCTCAGGTGGTGGTGGTTCTGGCGGCGGCGGCTCCGGTGGT<br>GGTGGTTCTCAGACTGTTGTGACTCAGGAACCTTCACTCACCGTATCA<br>CCTGGTGGAACAGTCACACTCACTTGTGGCTCCTCGACTGGGGCTGTT<br>ACATCTGGCAACTACCCAAACTGGGTCCAACAAAAACCAGGTCAGGCA<br>CCCCGTGGTCTAATAGGTGGGACTAAGTTCCTCGCCCCCGGTACTCCT<br>GCCAGATTCTCAGGCTCCCTGCTTGGAGGCAAGGCTGCCCTCACCCTC<br>TCAGGGGTACAGCCAGAGGATGAGGCAGAATATTACTGTGTTCTATGG<br>TACAGCAACCGCTGGGTGTTCGGTGGAGGAACCAAACTGACTGTCCTA |
| 589. | PMH8H2-VH | artificial | aa | QVQLVQSGAEVVKPGASVKLSCKASGFTITDTYMDWVRQAPGQGLEWI<br>GRIDPANGDSKYDPKFQGRATITPDTSTNTVYMELSSLRSEDTAVYYC<br>ARGGMIWYFDVWGQGTTVTVSS |
| 590. | PMH8H2-HCDR1 | artificial | aa | DTYMD |
| 591. | PMH8H2-HCDR2 | artificial | aa | RIDPANGDSKYDPKFQG |
| 592. | PMH8H2-HCDR3 | artificial | aa | GGMIWYFDV |
| 593. | PMH8H2-VH | artificial | nt | CAGGTGCAGCTGGTCCAGTCTGGGGCAGAGGTTGTGAAGCCAGGGGCC<br>TCAGTCAAGTTGTCCTGCAAAGCTTCTGGCTTCACCATTACAGACACC<br>TATATGGACTGGGTGAGGCAGGCGCCTGGACAGGGCCTGGAATGGATT<br>GGAAGGATTGATCCTGCGAATGGTGATAGTAAATATGACCCGAAATTC<br>CAGGGCAGGGCCACTATAACACCAGACACATCCACCAACACAGTCTAC<br>ATGGAGCTCAGCAGCCTGAGATCTGAGGACACTGCCGTCTATTATTGT<br>GCTAGAGGCGGGATGATATGGTACTTCGATGTCTGGGGCCAAGGGACC<br>ACGGTCACCGTCTCCTCA |
| 594. | PMH8H2-VL | artificial | aa | EIVLTQSPATMALSPGERATLSCSASSSISSNYLHWYQQKPGLPPRLL<br>IYRTSNLASGIPDRFSGSGSGTDFTLTISRLEPEDVAVYYCQQGSSLP<br>YTFGQGTKLEIK |

| SEQ ID NO. | DESIGNATION | SOURCE | TYPE | SEQUENCE |
|---|---|---|---|---|
| 595. | PMH8H2-LCDR1 | artificial | aa | SASSSISSNYLH |
| 596. | PMH8H2-LCDR2 | artificial | aa | RTSNLAS |
| 597. | PMH8H2-LCDR3 | artificial | aa | QQGSSLPYT |
| 598. | PMH8H2-VL | artificial | nt | GAGATCGTGCTCACCCAGTCTCCAGCCACCATGGCTCTATCTCCCGGG GAGAGGGCCACTCTCTCCTGCAGTGCCAGCTCAAGTATAAGTTCCAAT TACTTGCATTGGTATCAGCAGAAGCCAGGATTGCCCCCTAGACTCTTG ATTTATAGGACATCCAATCTGGCTTCTGGAATCCCAGATCGCTTCAGT GGCAGTGGGTCTGGGACCGATTTCACTCTCACAATTAGCAGGCTGGAG CCTGAAGATGTTGCCGTTTACTACTGCCAGCAGGGTAGTAGTTTACCG TACACGTTCGGACAAGGGACCAAGCTTGAGATCAAA |
| 599. | PMH8H2-VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATM ALSPGERATLSCSASSSISSNYLHWYQQKPGLPPRLLIYRTSNLASGI PDRFSGSGSGTDFTLTISRLEPEDVAVYYCQQGSSLPYTFGQGTKLEI K |
| 600. | PMH8H2-VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCATG GCTCTATCTCCCGGGGAGAGGGCCACTCTCTCCTGCAGTGCCAGCTCA AGTATAAGTTCCAATTACTTGCATTGGTATCAGCAGAAGCCAGGATTG CCCCCTAGACTCTTGATTTATAGGACATCCAATCTGGCTTCTGGAATC CCAGATCGCTTCAGTGGCAGTGGGTCTGGGACCGATTTCACTCTCACA ATTAGCAGGCTGGAGCCTGAAGATGTTGCCGTTTACTACTGCCAGCAG GGTAGTAGTTTACCGTACACGTTCGGACAAGGGACCAAGCTTGAGATC AAA |
| 601. | PMH8H2 VH-VL × I2C VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATM ALSPGERATLSCSASSSISSNYLHWYQQKPGLPPRLLIYRTSNLASGI PDRFSGSGSGTDFTLTISRLEPEDVAVYYCQQGSSLPYTFGQGTKLEI KSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLW YSNRWVFGGGTKLTVL |
| 602. | PMH8H2 VH-VL × I2C VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCATG GCTCTATCTCCCGGGGAGAGGGCCACTCTCTCCTGCAGTGCCAGCTCA AGTATAAGTTCCAATTACTTGCATTGGTATCAGCAGAAGCCAGGATTG CCCCCTAGACTCTTGATTTATAGGACATCCAATCTGGCTTCTGGAATC CCAGATCGCTTCAGTGGCAGTGGGTCTGGGACCGATTTCACTCTCACA ATTAGCAGGCTGGAGCCTGAAGATGTTGCCGTTTACTACTGCCAGCAG GGTAGTAGTTTACCGTACACGTTCGGACAAGGGACCAAGCTTGAGATC AAATCCGGAGGTGGTGGATCCGAGGTGCAGCTGGTCGAGTCTGGAGGA GGATTGGTGCAGCCTGGAGGGTCATTGAAACTCTCATGTGCAGCCTCT GGATTCACCTTCAATAAGTACGCCATGAACTGGGTCCGCCAGGCTCCA GGAAAGGGTTTGGAATGGGTTGCTCGCATAAGAAGTAAATATAATAAT TATGCAACATATTATGCCGATTCAGTGAAAGACAGGTTCACCATCTCC AGAGATGATTCAAAAAACACTGCCTATCTACAAATGAACAACTTGAAA ACTGAGGACACTGCCGTGTACTACTGTGTGAGACATGGGAACTTCGGT AATAGCTACATATCCTACTGGGCTTACTGGGGCCAAGGGACTCTGGTC ACCGTCTCCTCAGGTGGTGGTGGTTCTGGCGGCGGCGGCTCCGGTGGT GGTGGTTCTCAGACTGTTGTGACTCAGGAACCTTCACTCACCGTATCA CCTGGTGGAACAGTCACACTCACTTGTGGCTCCTCGACTGGGGCTGTT |

| SEQ ID NO. | DESIGNATION | SOURCE | TYPE | SEQUENCE |
|---|---|---|---|---|
| | | | | ACATCTGGCAACTACCCAAACTGGGTCCAACAAAAACCAGGTCAGGCA CCCCGTGGTCTAATAGGTGGGACTAAGTTCCTCGCCCCCGGTACTCCT GCCAGATTCTCAGGCTCCCTGCTTGGAGGCAAGGCTGCCCTCACCCTC TCAGGGGTACAGCCAGAGGATGAGGCAGAATATTACTGTGTTCTATGG TACAGCAACCGCTGGGTGTTCGGTGGAGGAACCAAACTGACTGTCCTA |
| 603. | PMH8H3-VH | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSS |
| 604. | PMH8H3-HCDR1 | artificial | aa | DTYMD |
| 605. | PMH8H3-HCDR2 | artificial | aa | RIDPANGDSKYDPKFQG |
| 606. | PMH8H3-HCDR3 | artificial | aa | GGMIWYFDV |
| 607. | PMH8H3-VH | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCA |
| 608. | PMH8H3-VL | artificial | aa | EIVLTQSPATLSLSPGERITLSCSASSSISSNYLHWYQQKPGLPPRLL IYRTSNLASGIPDRFSGSGSGTDFTLTIGTLEPEDFAVYYCQQGSSLP YTFGQGTKLEIK |
| 609. | PMH8H3-LCDR1 | artificial | aa | SASSSISSNYLH |
| 610. | PMH8H3-LCDR2 | artificial | aa | RTSNLAS |
| 611. | PMH8H3-LCDR3 | artificial | aa | QQGSSLPYT |
| 612. | PMH8H3-VL | artificial | nt | GAGATCGTGCTCACCCAGTCTCCAGCCACCCTGTCTCTATCTCCCGGG GAGAGGGATCACTCTCCTGCAGTGCCAGCTCAAGTATAAGTTCCAAT TACTTGCATTGGTATCAGCAGAAGCCAGGATTACCCCCTAGACTCTTG ATTTATAGGACATCCAATCTGGCTTCTGGAATCCCAGATCGCTTCAGT GGCAGTGGGTCTGGGACCGATTTCACTCTCACAATTGGCACGCTGGAG CCTGAAGATTTTGCCGTTTACTACTGCCAGCAGGGTAGTAGTTTACCG TACACGTTCGGACAAGGGACCAAGCTTGAGATCAAA |
| 613. | PMH8H3-VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATL SLSPGERITLSCSASSSISSNYLHWYQQKPGLPPRLL IYRTSNLASGI PDRFSGSGSGTDFTLTIGTLEPEDFAVYYCQQGSSLPYTFGQGTKLEI K |
| 614. | PMH8H3-VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCCTG TCTCTATCTCCCGGGGAGAGGGATCACTCTCCTGCAGTGCCAGCTCA AGTATAAGTTCCAATTACTTGCATTGGTATCAGCAGAAGCCAGGATTA CCCCCTAGACTCTTGATTTATAGGACATCCAATCTGGCTTCTGGAATC CCAGATCGCTTCAGTGGCAGTGGGTCTGGGACCGATTTCACTCTCACA ATTGGCACGCTGGAGCCTGAAGATTTTGCCGTTTACTACTGCCAGCAG GGTAGTAGTTTACCGTACACGTTCGGACAAGGGACCAAGCTTGAGATC AAA |
| 615. | PMH8H3 VH-VL × I2C VH-VL | artificial | aa | QVQLVQSGAEVVKPGASVKLSCKASGFTITDTYMDWVRQAPGQGLEWI GRIDPANGDSKYDPKFQGRATITPDTSTNTVYMELSSLRSEDTAVYYC ARGGMIWYFDVWGQGTTVTVSSGGGGSGGGGSGGGGSEIVLTQSPATL SLSPGERITLSCSASSSISSNYLHWYQQKPGLPPRLLIYRTSNLASGI PDRFSGSGSGTDFTLTIGTLEPEDFAVYYCQQGSSLPYTFGQGTKLEI KSGGGGSEVQLVESGGGLVQPGGSLKLSCAASGFTFNKYAMNWVRQAP GKGLEWVARIRSKYNNYATYYADSVKDRFTISRDDSKNTAYLQMNNLK TEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQA |

| SEQ ID NO. | DESIGNATION | SOURCE | TYPE | SEQUENCE |
|---|---|---|---|---|
| | | | | PRGLIGGTKFLAPGTPARFSGSLLGGKAALTLSGVQPEDAEYYCVLW YSNRWVFGGGTKLTVL |
| 616. | PMH8H3 VH-VL × I2C VH-VL | artificial | nt | CAGGTGCAGCTGGTCCAGTCTGGGGCAGAGGTTGTGAAGCCAGGGGCC TCAGTCAAGTTGTCCTGCAAAGCTTCTGGCTTCACCATTACAGACACC TATATGGACTGGGTGAGGCAGGCGCCTGGACAGGGCCTGGAATGGATT GGAAGGATTGATCCTGCGAATGGTGATAGTAAATATGACCCGAAATTC CAGGGCAGGGCCACTATAACACCAGACACATCCACCAACACAGTCTAC ATGGAGCTCAGCAGCCTGAGATCTGAGGACACTGCCGTCTATTATTGT GCTAGAGGCGGGATGATATGGTACTTCGATGTCTGGGGCCAAGGGACC ACGGTCACCGTCTCCTCAGGTGGTGGTGGTTCTGGCGGCGGCGGCTCC GGTGGTGGTGGTTCTGAGATCGTGCTCACCCAGTCTCCAGCCACCCTG TCTCTATCTCCCGGGGAGAGGATCACTCTCTCCTGCAGTGCCAGCTCA AGTATAAGTTCCAATTACTTGCATTGGTATCAGCAGAAGCCAGGATTA CCCCCTAGACTCTTGATTTATAGGACATCCAATCTGGCTTCTGGAATC CCAGATCGCTTCAGTGGCAGTGGGTCTGGGACCGATTTCACTCTCACA ATTGGCACGCTGGAGCCTGAAGATTTTGCCGTTTACTACTGCCAGCAG GGTAGTAGTTTACCGTACACGTTCGGACAAGGGACCAAGCTTGAGATC AAATCCGGAGGTGGTGGATCCGAGGTGCAGCTGGTCGAGTCTGGAGGA GGATTGGTGCAGCCTGGAGGGTCATTGAAACTCTCATGTGCAGCCTCT GGATTCACCTTCAATAAGTACGCCATGAACTGGGTCCGCCAGGCTCCA GGAAAGGGTTTGGAATGGGTTGCTCGCATAAGAAGTAAATATAATAAT TATGCAACATATTATGCCGATTCAGTGAAAGACAGGTTCACCATCTCC AGAGATGATTCAAAAAACACTGCCTATCTACAAATGAACAACTTGAAA ACTGAGGACACTGCCGTGTACTACTGTGTGAGACATGGGAACTTCGGT AATAGCTACATATCCTACTGGGCTTACTGGGGCCAAGGGACTCTGGTC ACCGTCTCCTCAGGTGGTGGTGGTTCTGGCGGCGGCGGCTCCGGTGGT GGTGGTTCTCAGACTGTTGTGACTCAGGAACCTTCACTCACCGTATCA CCTGGTGGAACAGTCACACTCACTTGTGGCTCCTCGACTGGGGCTGTT ACATCTGGCAACTACCCAAACTGGGTCCAACAAAAACCAGGTCAGGCA CCCCGTGGTCTAATAGGTGGGACTAAGTTCCTCGCCCCCGGTACTCCT GCCAGATTCTCAGGCTCCCTGCTTGGAGGCAAGGCTGCCCTCACCCTC TCAGGGGTACAGCCAGAGGATGAGGCAGAATATTACTGTGTTCTATGG TACAGCAACCGCTGGGTGTTCGGTGGAGGAACCAAACTGACTGTCCTA |
| 617. | PM74G3-VH | artificial | aa | QVQLVQSGAEVKKPGASVKLSCKASGYTFTYFDINWVRQAPEQGLEWM GGISPGDGNTNYNENFKGRVTMTIDTSSSTAYIELSRLTSDDTAVYYC ARDGNFPYYAMDSWGQGTTVTVSS |
| 618. | PM74G3-HCDR1 | artificial | aa | YFDIN |
| 619. | PM74G3-HCDR2 | artificial | aa | GISPGDGNTNYNENFKG |
| 620. | PM74G3-HCDR3 | artificial | aa | DGNFPYYAMDS |
| 621. | PM74G3-VH | artificial | nt | CAGGTGCAGCTGGTCCAGTCTGGCGCCGAAGTGAAGAAGCCTGGCGCC TCCGTGAAGCTGTCCTGCAAGGCCTCCGGCTACACCTTCACCTACTTC GACATCAACTGGGTGCGGCAGGCGCCTGAGCAGGGCCTGGAATGGATG GGCGGCATCTCCCCTGGCGACGGCAACACCAACTACAACGAGAACTTC AAGGGCAGGGTCACAATGACCATAGACACGTCCAGCTCCACCGCCTAC ATCGAGCTGTCCCGGCTGACATCTGACGACACCGCCGTGTACTACTGC GCCAGGGACGGCAACTTCCCTTACTACGCCATGGACTCTTGGGGCCAG GGCACCACGGTGACCGTCTCCTCA |
| 622. | PM74G3-VL | artificial | aa | DVVMTQTPLSLPVSLGDQASISCRSSQSLVHSNGNTYLHWYLQKPGQS PKLLIYKVSNRFSGVPDRFSGSGSGTDFTLKISRVEAEDLGVYFCSQS THVPYTFGGGTKLEIK |
| 623. | PM74G3-LCDR1 | artificial | aa | RSSQSLVHSNGNTYLH |
| 624. | PM74G3-LCDR2 | artificial | aa | KVSNRFS |
| 625. | PM74G3-LCDR3 | artificial | aa | SQSTHVPYT |
| 626. | PM74G3-VL | artificial | nt | GACGTCGTGATGACCCAGACTCCACTCTCCCTGCCTGTCAGTCTTGGA GATCAAGCCTCCATCTCTTGCAGATCTAGTCAGAGCCTTGTACACAGT AATGGAAACACCTATTTACATTGGTACCTGCAGAAGCCAGGCCAGTCT CCAAAGCTCCTGATCTACAAAGTTTCCAACCGATTTTCTGGGGTCCCA GACAGGTTCAGTGGCAGTGGATCAGGGACAGATTTCACACTCAAGATC AGCAGAGTGGAGGCTGAGGATCTGGGAGTTTATTTCTGCTCTCAAAGT ACACATGTTCCGTACACGTTCGGAGGGGGGACCAAGCTTGAGATCAAA |
| 627. | PM74G3-VH-VL | artificial | aa | QVQLVQSGAEVKKPGASVKLSCKASGYTFTYFDINWVRQAPEQGLEWM GGISPGDGNTNYNENFKGRVTMTIDTSSSTAYIELSRLTSDDTAVYYC ARDGNFPYYAMDSWGQGTTVTVSSGGGGSGGGGSGGGGSDVVMTQTPL SLPVSLGDQASISCRSSQSLVHSNGNTYLHWYLQKPGQSPKLLIYKVS |

-continued

| SEQ ID NO. | DESIGNATION | SOURCE | TYPE | SEQUENCE |
|---|---|---|---|---|
| | | | | NRFSGVPDRFSGSGSGTDFTLKISRVEAEDLGVYFCSQSTHVPYTFGG GTKLEIK |
| 628. | PM74G3-VH-VL | artificial | nt | CAGGTGCAGCTGGTCCAGTCTGGCGCCGAAGTGAAGAAGCCTGGCGCC TCCGTGAAGCTGTCCTGCAAGGCCTCCGGCTACACCTTCACCTACTTC GACATCAACTGGGTGCGGCAGGCGCCTGAGCAGGGCCTGGAATGGATG GGCGGCATCTCCCCTGGCGACGGCAACACCAACTACAACGAGAACTTC AAGGGCAGGGTCACAATGACCATAGACACGTCCAGCTCCACCGCCTAC ATCGAGCTGTCCCGGCTGACATCTGACGACACCGCCGTGTACTACTGC GCCAGGGACGGCAACTTCCCTTACTACGCCATGGACTCTTGGGGCCAG GGCACCACGGTGACCGTCTCCTCAGGTGGTGGTGGTTCTGGCGGCGGC GGCTCCGGTGGTGGTGGTTCTGACGTCGTGATGACCCAGACTCCACTC TCCCTGCCTGTCAGTCTTGGAGATCAAGCCTCCATCTCTTGCAGATCT AGTCAGAGCCTTGTACACAGTAATGGAAACACCTATTTACATTGGTAC CTGCAGAAGCCAGGCCAGTCTCCAAAGCTCCTGATCTACAAAGTTTCC AACCGATTTTCTGGGGTCCCAGACAGGTTCAGTGGCAGTGGATCAGGG ACAGATTTCACACTCAAGATCAGCAGAGTGGAGGCTGAGGATCTGGGA GTTTATTTCTGCTCTCAAAGTACACATGTTCCGTACACGTTCGGAGGG GGGACCAAGCTTGAGATCAAA |
| 629. | PM74G3 VH-VL × I2C VH-VL | artificial | aa | QVQLVQSGAEVKKPGASVKLSCKASGYTFTYFDINWVRQAPEQGLEWM GGISPGDGNTNYNENFKGRVTMTIDTSSSTAYIELSRLTSDDTAVYYC ARDGNFPYYAMDSWGQGTTVTVSSGGGGSGGGGSGGGGSDVVMTQTPL SLPVSLGDQASISCRSSQSLVHSNGNTYLHWYLQKPGQSPKLLIYKVS NRFSGVPDRFSGSGSGTDFTLKISRVEAEDLGVYFCSQSTHVPYTFGG GTKLEIKSGGGGSEVQLVESGGGLVQPGGSLKLSCAASGFTFNKYAMN WVRQAPGKGLEWVARIRSKYNNYATYYADSVKDRFTISRDDSKNTAYL QMNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWVQ QKPGQAPRGLIGGTKFLAPGTPARFSGSLLGGKAALTLSGVQPEDEAE YYCVLWYSNRWVFGGGTKLTVL |
| 630. | PM74G3 VH-VL × I2C VH-VL | artificial | nt | CAGGTGCAGCTGGTCCAGTCTGGCGCCGAAGTGAAGAAGCCTGGCGCC TCCGTGAAGCTGTCCTGCAAGGCCTCCGGCTACACCTTCACCTACTTC GACATCAACTGGGTGCGGCAGGCGCCTGAGCAGGGCCTGGAATGGATG GGCGGCATCTCCCCTGGCGACGGCAACACCAACTACAACGAGAACTTC AAGGGCAGGGTCACAATGACCATAGACACGTCCAGCTCCACCGCCTAC ATCGAGCTGTCCCGGCTGACATCTGACGACACCGCCGTGTACTACTGC GCCAGGGACGGCAACTTCCCTTACTACGCCATGGACTCTTGGGGCCAG GGCACCACGGTGACCGTCTCCTCAGGTGGTGGTGGTTCTGGCGGCGGC GGCTCCGGTGGTGGTGGTTCTGACGTCGTGATGACCCAGACTCCACTC TCCCTGCCTGTCAGTCTTGGAGATCAAGCCTCCATCTCTTGCAGATCT AGTCAGAGCCTTGTACACAGTAATGGAAACACCTATTTACATTGGTAC CTGCAGAAGCCAGGCCAGTCTCCAAAGCTCCTGATCTACAAAGTTTCC AACCGATTTTCTGGGGTCCCAGACAGGTTCAGTGGCAGTGGATCAGGG ACAGATTTCACACTCAAGATCAGCAGAGTGGAGGCTGAGGATCTGGGA GTTTATTTCTGCTCTCAAAGTACACATGTTCCGTACACGTTCGGAGGG GGGACCAAGCTTGAGATCAAATCCGGAGGTGGTGGATCCGAGGTGCAG CTGGTCGAGTCTGGAGGAGGATTGGTGCAGCCTGGAGGGTCATTGAAA CTCTCATGTGCAGCCTCTGGATTCACCTTCAATAAGTACGCCATGAAC TGGGTCCGCCAGGCTCCAGGAAAGGGTTTGGAATGGGTTGCTCGCATA AGAAGTAAATATAATAATTATGCAACATATTATGCCGATTCAGTGAAA GACAGGTTCACCATCTCCAGAGATGATTCAAAAAACACTGCCTATCTA CAAATGAACAACTTGAAAACTGAGGACACTGCCGTGTACTACTGTGTG AGACATGGGAACTTCGGTAATAGCTACATATCCTACTGGGCTTACTGG GGCCAAGGGACTCTGGTCACCGTCTCCTCAGGTGGTGGTGGTTCTGGC GGCGGCGGCTCCGGTGGTGGTGGTTCTCAGACTGTTGTGACTCAGGAA CCTTCACTCACCGTATCACCTGGTGGAACAGTCACACTCACTTGTGGC TCCTCGACTGGGGCTGTTACATCTGGCAACTACCCAAACTGGGTCCAA CAAAAACCAGGTCAGGCACCCCGTGGTCTAATAGGTGGGACTAAGTTC CTCGCCCCCGGTACTCCTGCCAGATTCTCAGGCTCCCTGCTTGGAGGC AAGGCTGCCCTCACCCTCTCAGGGGTACAGCCAGAGGATGAGGCAGAA TATTACTGTGTTCTATGGTACAGCAACCGCTGGGTGTTCGGTGGAGGA ACCAAACTGACTGTCCTA |
| 631. | Macaca fascicularis CD3ε 1-27 | Macaca fascicularis | aa | QDGNEEMGSITQTPYQVSISGTTILTC |
| 632. | Macaca fascicularis CD3ε 1-27 | Macaca fascicularis | aa | QDGNEEMGSITQTPYQVSISGTTVILT |
| 633. | Macaca mulatta CD3ε 1-27 | Macaca mulatta | aa | QDGNEEMGSITQTPYHVSISGTTVILT |

SEQUENCE LISTING (634 sequences)

SEQ ID NO: 1 - protein, 105 aa, Homo sapiens
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD

SEQ ID NO: 2 - protein, 27 aa, Homo sapiens
QDGNEEMGGITQTPYKVSISGTTVILT

SEQ ID NO: 3 - protein, 96 aa, Callithrix jacchus
QDGNEEMGDTTQNPYKVSISGTTVTLTCPRYDGHEIKWLVNSQNKEGHEDHLLLEDFSEMEQSGYYACLSKETPAEEASHYLYLKARVCENCVEVD

SEQ ID NO: 4 - protein, 27 aa, Callithrix jacchus
QDGNEEMGDTTQNPYKVSISGTTVTLT

SEQ ID NO: 5 - protein, 96 aa, Saguinus oedipus; identical to SEQ ID NO: 3

SEQ ID NO: 6 - protein, 27 aa, Saguinus oedipus
QDGNEEMGDTTQNPYKVSISGTTVTLT

SEQ ID NO: 7 - protein, 96 aa, Saimiri sciureus
QDGNEEIGDTTQNPYKVSISGTTVTLTCPRYDGQEIKWLVNDQNKEGHEDHLLLEDFSEMEQSGYYACLSKETPTEEASHYLYLKARVCENCVEVD

SEQ ID NO: 8 - protein, 27 aa, Saimiri sciureus
QDGNEEIGDTTQNPYKVSISGTTVTLT

SEQ ID NO: 9 - protein, 14 aa, artificial
  CDR-L1 of F6A
GSSTGAVTSGYYPN

SEQ ID NO: 10 - protein, 7 aa, artificial
  CDR-L2 of F6A
GTKFLAP

SEQ ID NO: 11 - protein, 9 aa, artificial
  CDR-L3 of F6A
ALWYSNRWV

SEQ ID NO: 12 - protein, 5 aa, artificial
  CDR-H1 of F6A
IYAMN

SEQ ID NO: 13 - protein, 19 aa, artificial
  CDR-H2 of F6A
RIRSKYNNYATYYADSVKS

SEQ ID NO: 14 - protein, 14 aa, artificial
  CDR-H3 of F6A
HGNFGNSYVSFFAY

SEQ ID NO: 15 - protein, 125 aa, artificial
  VH of 6FA
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 16 - DNA, 375 bp, artificial
  VH of 6FA
gaggtgcagctggtcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctca

SEQ ID NO: 17 - protein, 109 aa, artificial
  VL of 6FA
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 18 - DNA, 327 bp, artificial
  VL of 6FA
cagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 19 - protein, 125 aa, artificial
  VH-P of 6FA
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 20 - DNA, 375 bp, artificial
  VH-P of 6FA
gaggtgcagctgctcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctca

SEQ ID NO: 21 - protein, 109 aa, artificial
  VL-P of 6FA
ELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 22 - DNA, 327 bp, artificial
  VL-P of 6FA
gagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 23 - protein, 249 aa, artificial
  VH-VL of 6FA
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 24 - DNA, 747 bp, artificial
  VH-VL of 6FA
gaggtgcagctggtcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 25 - protein, 249 aa, artificial
  VH-VL-P of 6FA
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 26 - DNA, 747 bp, artificial
  VH-VL-P of 6FA
gaggtgcagctgctcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 27 - protein, 14 aa, artificial
  CDR-L1 of H2C
GSSTGAVTSGYYPN

SEQ ID NO: 28 - protein, 7 aa, artificial
  CDR-L2 of H2C
GTKFLAP

SEQ ID NO: 29 - protein, 9 aa, artificial
  CDR-L3 of H2C
ALWYSNRWV

SEQ ID NO: 30 - protein, 5 aa, artificial
  CDR-H1 of H2C
KYAMN

SEQ ID NO: 31 - protein, 19 aa, artificial
  CDR-H2 of H2C
RIRSKYNNYATYYADSVKD

SEQ ID NO: 32 - protein, 14 aa, artificial
  CDR-H3 of H2C
HGNFGNSYISYWAY

SEQ ID NO: 33 - protein, 125 aa, artificial
  VH of H2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 34 - DNA, 375 bp, artificial
  VH of H2C
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctca

SEQ ID NO: 35 - protein, 109 aa, artificial; identical to SEQ ID NO: 17
  VL of H2C

SEQ ID NO: 36 - DNA, 327 bp, artificial; identical to SEQ ID NO: 18
  VL of H2C

SEQ ID NO: 37 - protein, 125 aa, artificial
  VH-P of H2C
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 38 - DNA, 375 bp, artificial
  VH-P of H2C
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctca

SEQ ID NO: 39 - protein, 109 aa, artificial; identical to SEQ ID NO: 21
  VL-P of H2C

SEQ ID NO: 40 - DNA, 327 bp, artificial; identical to SEQ ID NO: 22
  VL-P of H2C

SEQ ID NO: 41 - protein, 249 aa, artificial
  VH-VL of H2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 42 - DNA, 747 bp, artificial
  VH-VL of H2C
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 43 - protein, 249 aa, artificial
  VH-VL-P of H2C
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 44 - DNA, 747 bp, artificial
  VH-VL-P of H2C
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 45 - protein, 14 aa, artificial
  CDR-L1 of H1E
GSSTGAVTSGYYPN

SEQ ID NO: 46 - protein, 7 aa, artificial
  CDR-L2 of H1E
GTKFLAP

SEQ ID NO: 47 - protein, 9 aa, artificial
  CDR-L3 of H1E
ALWYSNRWV

SEQ ID NO: 48 - protein, 5 aa, artificial
  CDR-H1 of H1E
SYAMN

SEQ ID NO: 49 - protein, 19 aa, artificial
  CDR-H2 of H1E
RIRSKYNNYATYYADSVKG

SEQ ID NO: 50 - protein, 14 aa, artificial
  CDR-H3 of H1E
HGNFGNSYLSFWAY

SEQ ID NO: 51 - protein, 125 aa, artificial
  VH of H1E
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 52 - DNA, 374 bp, artificial
  VH of H1E
gaggtgcagctggtcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctc

SEQ ID NO: 53 - protein, 109 aa, artificial; identical to SEQ ID NO: 17
  VL of H1E

SEQ ID NO: 54 - DNA, 327 bp, artificial; identical to SEQ ID NO: 18
  VL of H1E

SEQ ID NO: 55 - protein, 125 aa, artificial
  VH-P of H1E
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 56 - DNA, 375 bp, artificial
  VH-P of H1E
gaggtgcagctgctcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctca

SEQ ID NO: 57 - protein, 109 aa, artificial; identical to SEQ ID NO: 21
  VL-P of H1E

SEQ ID NO: 58 - DNA, 327 bp, artificial; identical to SEQ ID NO: 22
  VL-P of H1E

SEQ ID NO: 59 - protein, 249 aa, artificial
  VH-VL of H1E
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 60 - DNA, 747 bp, artificial
  VH-VL of H1E
gaggtgcagctggtcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 61 - protein, 249 aa, artificial
  VH-VL-P of H1E
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 62 - DNA, 747 bp, artificial
  VH-VL-P of H1E
gaggtgcagctgctcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 63 - protein, 14 aa, artificial
  CDR-L1 of G4H
GSSTGAVTSGYYPN

SEQ ID NO: 64 - protein, 7 aa, artificial
  CDR-L2 of G4H
GTKFLAP

SEQ ID NO: 65 - protein, 9 aa, artificial
  CDR-L3 of G4H
ALWYSNRWV

SEQ ID NO: 66 - protein, 5 aa, artificial
  CDR-H1 of G4H
RYAMN

SEQ ID NO: 67 - protein, 19 aa, artificial
  CDR-H2 of G4H
RIRSKYNNYATYYADSVKG

SEQ ID NO: 68 - protein, 14 aa, artificial
  CDR-H3 of G4H
HGNFGNSYLSYFAY

SEQ ID NO: 69 - protein, 125 aa, artificial
  VH of G4H
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 70 - DNA, 375 bp, artificial
  VH of G4H
gaggtgcagctggtcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctca

SEQ ID NO: 71 - protein, 109 aa, artificial; identical to SEQ ID NO: 17
  VL of G4H

SEQ ID NO: 72 - DNA, 327 bp, artificial; identical to SEQ ID NO: 18
  VL of G4H

SEQ ID NO: 73 - protein, 125 aa, artificial
  VH-P of G4H
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 74 - DNA, 375 bp, artificial
  VH-P of G4H
gaggtgcagctgctcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctca

SEQ ID NO: 75 - protein, 109 aa, artificial; identical to SEQ ID NO: 21
  VL-P of G4H

SEQ ID NO: 76 - DNA, 327 bp, artificial; identical to SEQ ID NO: 22
  VL-P of G4H

SEQ ID NO: 77 - protein, 249 aa, artificial
  VH-VL of G4H
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 78 - DNA, 747 bp, artificial
  VH-VL of G4H
gaggtgcagctggtcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 79 - protein, 249 aa, artificial
  VH-VL-P of G4H
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 80 - DNA, 747 bp, artificial
  VH-VL-P of G4H
gaggtgcagctgctcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 81 - protein, 14 aa, artificial
  CDR-L1 of A2J
RSSTGAVTSGYYPN

SEQ ID NO: 82 - protein, 7 aa, artificial
  CDR-L2 of A2J
ATDMRPS

SEQ ID NO: 83 - protein, 9 aa, artificial
  CDR-L3 of A2J
ALWYSNRWV

SEQ ID NO: 84 - protein, 5 aa, artificial
  CDR-H1 of A2J
VYAMN

SEQ ID NO: 85 - protein, 19 aa, artificial
  CDR-H2 of A2J
RIRSKYNNYATYYADSVKK

SEQ ID NO: 86 - protein, 14 aa, artificial
  CDR-H3 of A2J
HGNFGNSYLSWWAY

SEQ ID NO: 87 - protein, 125 aa, artificial
  VH of A2J
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 88 - DNA, 375 bp, artificial
  VH of A2J
gaggtgcagctggtcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctca

SEQ ID NO: 89 - protein, 109 aa, artificial
  VL of A2J
QTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 90 - DNA, 327 bp, artificial
  VL of A2J
cagactgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 91 - protein, 125 aa, artificial
  VH-P of A2J
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 92 - DNA, 375 bp, artificial
  VH-P of A2J
gaggtgcagctgctcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctca

SEQ ID NO: 93 - protein, 109 aa, artificial
  VL-P of A2J
ELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 94 - DNA, 327 bp, artificial
  VL-P of A2J
gagctcgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 95 - protein, 249 aa, artificial
  VH-VL of A2J
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 96 - DNA, 747 bp, artificial
  VH-VL of A2J
gaggtgcagctggtcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 97 - protein, 249 aa, artificial
  VH-VL-P of A2J
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 98 - DNA, 747 bp, artificial
  VH-VL-P of A2J
gaggtgcagctgctcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 99 - protein, 14 aa, artificial
  CDR-L1 of E1L
GSSTGAVTSGYYPN

SEQ ID NO: 100 - protein, 7 aa, artificial
  CDR-L2 of E1L
GTKFLAP

SEQ ID NO: 101 - protein, 9 aa, artificial
  CDR-L3 of E1L
ALWYSNRWV

SEQ ID NO: 102 - protein, 5 aa, artificial
  CDR-H1 of E1L
KYAMN

SEQ ID NO: 103 - protein, 19 aa, artificial
  CDR-H2 of E1L
RIRSKYNNYATYYADSVKS

SEQ ID NO: 104 - protein, 14 aa, artificial
  CDR-H3 of E1L
HGNFGNSYTSYYAY

SEQ ID NO: 105 - protein, 125 aa, artificial
  VH of E1L
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 106 - DNA, 375 bp, artificial
  VH of E1L
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctca

SEQ ID NO: 107 - protein, 109 aa, artificial; identical to SEQ ID NO: 17
  VL of E1L

SEQ ID NO: 108 - DNA, 327 bp, artificial; identical to SEQ ID NO: 18
  VL of E1L

SEQ ID NO: 109 - protein, 125 aa, artificial
  VH-P of E1L
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 110 - DNA, 375 bp, artificial
  VH-P of E1L
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctca

SEQ ID NO: 111 - protein, 109 aa, artificial; identical to SEQ ID NO: 21
  VL-P of E1L

SEQ ID NO: 112 - DNA, 327 bp, artificial; identical to SEQ ID NO: 22
  VL-P of E1L

SEQ ID NO: 113 - protein, 249 aa, artificial
  VH-VL of E1L
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 114 - DNA, 747 bp, artificial
  VH-VL of E1L
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 115 - protein, 249 aa, artificial
  VH-VL-P of E1L
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 116 - DNA, 747 bp, artificial
  VH-VL-P of E1L
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 117 - protein, 14 aa, artificial
  CDR-L1 of E2M
RSSTGAVTSGYYPN

SEQ ID NO: 118 - protein, 7 aa, artificial
  CDR-L2 of E2M
ATDMRPS

SEQ ID NO: 119 - protein, 9 aa, artificial
  CDR-L3 of E2M
ALWYSNRWV

SEQ ID NO: 120 - protein, 5 aa, artificial
  CDR-H1 of E2M
GYAMN

SEQ ID NO: 121 - protein, 19 aa, artificial
  CDR-H2 of E2M
RIRSKYNNYATYYADSVKE

SEQ ID NO: 122 - protein, 14 aa, artificial
  CDR-H3 of E2M
HRNFGNSYLSWFAY

SEQ ID NO: 123 - protein, 125 aa, artificial
  VH of E2M
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 124 - DNA, 375 bp, artificial
  VH of E2M
gaggtgcagctggtcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctca

SEQ ID NO: 125 - protein, 109 aa, artificial; identical to SEQ ID NO: 89
  VL of E2M

SEQ ID NO: 126 - DNA, 327 bp, artificial; identical to SEQ ID NO: 90
  VL of E2M

SEQ ID NO: 127 - protein, 125 aa, artificial
  VH-P of E2M
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 128 - DNA, 375 bp, artificial
  VH-P of E2M
gaggtgcagctgctcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctca

SEQ ID NO: 129 - protein, 109 aa, artificial; identical to SEQ ID NO: 93
  VL-P of E2M

SEQ ID NO: 130 - DNA, 327 bp, artificial; identical to SEQ ID NO: 94
  VL-P of E2M

SEQ ID NO: 131 - protein, 249 aa, artificial
  VH-VL of E2M
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 132 - DNA, 747 bp, artificial
  VH-VL of E2M
gaggtgcagctggtcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 133 - protein, 249 aa, artificial
  VH-VL-P of E2M
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 134 - DNA, 747 bp, artificial
  VH-VL-P of E2M
gaggtgcagctgctcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 135 - protein, 14 aa, artificial
  CDR-L1 of F7O
GSSTGAVTSGYYPN

SEQ ID NO: 136 - protein, 7 aa, artificial
  CDR-L2 of F7O
GTKFLAP

SEQ ID NO: 137 - protein, 9 aa, artificial
  CDR-L3 of F7O
ALWYSNRWV

SEQ ID NO: 138 - protein, 5 aa, artificial
  CDR-H1 of F7O
VYAMN

SEQ ID NO: 139 - protein, 19 aa, artificial
  CDR-H2 of F7O
RIRSKYNNYATYYADSVKK

SEQ ID NO: 140 - protein, 14 aa, artificial
  CDR-H3 of F7O
HGNFGNSYISWWAY

SEQ ID NO: 141 - protein, 125 aa, artificial
  VH of F7O
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 142 - DNA, 375 bp, artificial
  VH of F7O
gaggtgcagctggtcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctca

SEQ ID NO: 143 - protein, 109 aa, artificial; identical to SEQ ID NO: 17
  VL of F7O

SEQ ID NO: 144 - DNA, 327 bp, artificial; identical to SEQ ID NO: 18
  VL of F7O

SEQ ID NO: 145 - protein, 125 aa, artificial
  VH-P of F7O
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 146 - DNA, 375 bp, artificial
  VH-P of F7O
gaggtgcagctgctcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctca

SEQ ID NO: 147 - protein, 109 aa, artificial; identical to SEQ ID NO: 21
  VL-P of F7O

SEQ ID NO: 148 - DNA, 327 bp, artificial; identical to SEQ ID NO: 22
  VL-P of F7O

SEQ ID NO: 149 - protein, 249 aa, artificial
  VH-VL of F7O
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 150 - DNA, 747 bp, artificial
  VH-VL of F7O
gaggtgcagctggtcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 151 - protein, 249 aa, artificial
  VH-VL-P of F7O
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 152 - DNA, 747 bp, artificial
  VH-VL-P of F7O
gaggtgcagctgctcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 153 - protein, 14 aa, artificial
  CDR-L1 of F12Q
GSSTGAVTSGNYPN

SEQ ID NO: 154 - protein, 7 aa, artificial
  CDR-L2 of F12Q
GTKFLAP

SEQ ID NO: 155 - protein, 9 aa, artificial
  CDR-L3 of F12Q
VLWYSNRWV

SEQ ID NO: 156 - protein, 5 aa, artificial
  CDR-H1 of F12Q
SYAMN

SEQ ID NO: 157 - protein, 19 aa, artificial
  CDR-H2 of F12Q
RIRSKYNNYATYYADSVKG

SEQ ID NO: 158 - protein, 14 aa, artificial
  CDR-H3 of F12Q
HGNFGNSYVSWWAY

SEQ ID NO: 159 - protein, 125 aa, artificial
  VH of F12Q
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 160 - DNA, 375 bp, artificial
  VH of F12Q
gaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctca

SEQ ID NO: 161 - protein, 109 aa, artificial
  VL of F12Q
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 162 - DNA, 327 bp, artificial
  VL of F12Q
cagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 163 - protein, 125 aa, artificial
  VH-P of F12Q
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 164 - DNA, 375 bp, artificial
  VH-P of F12Q
gaggtgcagctgctcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctca

SEQ ID NO: 165 - protein, 109 aa, artificial
  VL-P of F12Q
ELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 166 - DNA, 327 bp, artificial
  VL-P of F12Q
gagctcgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 167 - protein, 249 aa, artificial
  VH-VL of F12Q
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 168 - DNA, 747 bp, artificial
  VH-VL of F12Q
gaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 169 - protein, 249 aa, artificial
  VH-VL-P of F12Q
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 170 - DNA, 747 bp, artificial
  VH-VL-P of F12Q
gaggtgcagctgctcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 171 - protein, 14 aa, artificial
  CDR-L1 of I2C
GSSTGAVTSGNYPN

SEQ ID NO: 172 - protein, 7 aa, artificial
  CDR-L2 of I2C
GTKFLAP

SEQ ID NO: 173 - protein, 9 aa, artificial
  CDR-L3 of I2C
VLWYSNRWV

SEQ ID NO: 174 - protein, 5 aa, artificial
  CDR-H1 of I2C
KYAMN

SEQ ID NO: 175 - protein, 19 aa, artificial
  CDR-H2 of I2C
RIRSKYNNYATYYADSVKD

SEQ ID NO: 176 - protein, 14 aa, artificial
  CDR-H3 of I2C
HGNFGNSYISYWAY

SEQ ID NO: 177 - protein, 125 aa, artificial; identical to SEQ ID NO: 33
  VH of I2C

SEQ ID NO: 178 - DNA, 375 bp, artificial; identical to SEQ ID NO: 34
  VH of I2C

SEQ ID NO: 179 - protein, 109 aa, artificial; identical to SEQ ID NO: 161
  VL of I2C

SEQ ID NO: 180 - DNA, 327 bp, artificial; identical to SEQ ID NO: 162
  VL of I2C

SEQ ID NO: 181 - protein, 125 aa, artificial; identical to SEQ ID NO: 37
  VH-P of I2C

SEQ ID NO: 182 - DNA, 375 bp, artificial; identical to SEQ ID NO: 38
  VH-P of I2C

SEQ ID NO: 183 - protein, 109 aa, artificial; identical to SEQ ID NO: 165
  VL-P of I2C

SEQ ID NO: 184 - DNA, 327 bp, artificial; identical to SEQ ID NO: 166
  VL-P of I2C

SEQ ID NO: 185 - protein, 249 aa, artificial
  VH-VL of I2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 186 - DNA, 747 bp, artificial
  VH-VL of I2C
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 187 - protein, 249 aa, artificial
  VH-VL-P of I2C
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 188 - DNA, 747 bp, artificial
  VH-VL-P of I2C
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 189 - protein, 267 aa, artificial
  1-27 CD3 epsilon-Fc
QDGNEEMGGITQTPYKVSISGTTVILTSGEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 190 - DNA, 858 bp, artificial
  1-27 CD3 epsilon-Fc
atgggatggagctgtatcatcctcttcttggtagcaacagctacaggtgtacactcccaagatggtaatgaagaaatgggtggtattacacagacaccatataaagtctccatctctggaaccacagtaatattgacatccggagagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaacatcatcaccatcatcat

SEQ ID NO: 191 - protein, 333 aa, artificial
  human 1-27 CD3 epsilon-Fc-EpCAM
QDGNEEMGGITQTPYKVSISGTTVILTDYKDDDDKTASFAAAQKECVCENYKLAVNCFLNDNGQCQCTSIGAQNTVLCSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDVQSLRTALEEAIKTRYQLDPKFITNILYEDNVITIDLVQNSSQKTQNDVDIADVAYYFEKDVKGESLFHSKKMDLRVNGEQLDLDPGQTLIYYVDEKAPEFSMQGLKAGVIAVIVVVVIAIVAGIVVLVISRKKRMAKYEKAEIKEMGEMHRELNA

SEQ ID NO: 192 - DNA, 1056 bp, artificial
  human 1-27 CD3 epsilon-EpCAM
atgggatggagctgtatcatcctcttcttggtagcaacagctacaggtgtacactcccaagatggtaatgaagaaatgggtggtattacacagacaccatataaagtctccatctctggaaccacagtaatattgacagattacaaggacgacgatgacaagactgcgagttttgccgcagctcagaaagaatgtgtctgtgaaaactacaagctggccgtaaactgctttttgaatgacaatggtcaatgccagtgtacttcgattggtgcacaaaatactgtcctttgctcaaagctggctgccaaatgtttggtgatgaaggcagaaatgaacggctcaaaacttgggagaagagcgaaacctgaaggggctctccagaacaatgatggcctttacgatcctgactgcgatgagagcgggctctttaaggccaagcagtgcaacggcacctccacgtgctggtgtgtgaacactgctggggtcagaagaactgacaaggacactgaaataacctgctctgagcgagtgagaacctactggatcatcattgaattaaaacacaaagcaagagaaaaaccttatgatgttcaaagtttgcggactgcacttgaggaggcgatcaaaacgcgttatcaactggatccaaaatttatcacaaatattttgtatgaggataatgttatcactattgatctggttcaaaattcttctcagaaaactcagaatgatgtggacatagctgatgtggcttattattttgaaaaagatgttaaaggtgaatccttgtttcattctaagaaaatggacctgagagtaaatggggaacaactggatctggatcctggtcaaactttaatttattatgtcgatgaaaaagcacctgaattctcaatgcagggtctaaaagctggtgttattgctgttattgtggttgtggtgatagcaattgttgctggaattgttgtgctggttatttccagaaagaagagaatggcaaagtatgagaaggctgagataaaggagatgggtgagatgcatagggaactcaatgca

SEQ ID NO: 193 - protein, 333 aa, artificial
  marmoset 1-27 CD3 epsilon-EpCAM
QDGNEEMGDTTQNPYKVSISGTTVTLTDYKDDDDKTASFAAAQKECVCENYKLAVNCFLNDNGQCQCTSIGAQNTVLCSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDVQSLRTALEEAIKTRYQLDPKFITNILYEDNVITIDLVQNSSQKTQNDVDIADVAYYFEKDVKGESLFHSKKMDLRVNGEQLDLDPGQTLIYYVDEKAPEFSMQGLKAGVIAVIVVVVIAIVAGIVVLVISRKKRMAKYEKAEIKEMGEMHRELNA

SEQ ID NO: 194 - DNA, 1056 bp, artificial
  marmoset 1-27 CD3 epsilon-EpCAM
atgggatggagctgtatcatcctcttcttggtagcaacagctacaggtgtacactcccaggacggtaatgaagaaatgggtgatactacacagaacccatataaagtttccatctcaggaaccacagtaacactgacagattacaaggacgacgatgacaagactgcgagttttgccgcagctcagaaagaatgtgtctgtgaaaactacaagctggccgtaaactgctttttgaatgacaatggtcaatgccagtgtacttcgattggtgcacaaaatactgtcctttgctcaaagctggctgccaaatgtttggtgatgaaggcagaaatgaacggctcaaaacttgggagaagagcgaaacctgaaggggctctccagaacaatgatggcctttacgatcctgactgcgatgagagcgggctctttaaggccaagcagtgcaacggcacctccacgtgctggtgtgtgaacactgctggggtcagaagaactgacaaggacactgaaataacctgctctgagcgagtgagaacctactggatcatcattgaattaaaacacaaagcaagagaaaaaccttatgatgttcaaagtttgcggactgcacttgaggaggcgatcaaaacgcgttatcaactggatccaaaatttatcacaaatattttgtatgaggataatgttatcactattgatctggttcaaaattcttctcagaaaactcagaatgatgtggacatagctgatgtggcttattattttgaaaaagatgttaaaggtgaatccttgtttcattctaagaaaatggacctgagagtaaatggggaacaactggatctggatcctggtcaaactttaatttattatgtcgatgaaaaagcacctgaattctcaatgcagggtctaaaagctggtgttattgctgttattgtggttgtggtgatagcaattgttgctggaattgttgtgctggttatttccagaaagaagagaatggcaaagtatgagaaggctgagataaaggagatgggtgagatgcatagggaactcaatgca

SEQ ID NO: 195 - protein, 333 aa, artificial; identical to SEQ ID NO: 193
  tamarin 1-27 CD3 epsilon-EpCAM

SEQ ID NO: 196 - DNA, 1056 bp, artificial; identical to SEQ ID NO: 194
  tamarin 1-27 CD3 epsilon-EpCAM

SEQ ID NO: 197 - protein, 369 aa, artificial
  squirrel monkey 1-27 CD3 epsilon-EpCAM
QDGNEEIGDTTQNPYKVSISGTTVTLTDYKDDDDKTASFAAAQKECVCENYKLAVNCFLNDNGQCQCTSIGAQNTVLCSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDVQSLRTALEEAIKTRYQLDPKFITNILYEDNVITIDLVQNSSQKTQNDVDIADVAYYFEKDVKGESLFHSKKMDLRVNGEQLDLDPGQTLIYYVDEKAPEFSMQGLKAGVIAVIVVVVIAIVAGIVVLVISRKKRMAKYEKAEIKEMGEMHRELNAAAGGAGATGGGTGAGATGCATAGGGAACTCAATGCA

SEQ ID NO: 198 - DNA, 1056 bp, artificial
  squirrel monkey 1-27 CD3 epsilon-EpCAM
atgggatggagctgtatcatcctcttcttggtagcaacagctacaggtgtacactcccaggacggtaatgaagagattggtgatactacccagaacccatataaagtttccatctcaggaaccacagtaacactgacagattacaaggacgacgatgacaagactgcgagttttgccgcagctcagaaagaatgtgtctgtgaaaactacaagctggccgtaaactgctttttgaatgacaatggtcaatgccagtgtacttcgattggtgcacaaaatactgtcctttgctcaaagctggctgccaaatgtttggtgatgaaggcagaaatgaacggctcaaaacttgggagaagagcgaaacctgaaggggctctccagaacaatgatggcctttacgatcctgactgcgatgagagcgggctctttaaggccaagcagtgcaacggcacctccacgtgctggtgtgtgaacactgctggggtcagaagaactgacaaggacactgaaataacctgctctgagcgagtgagaacctactggatcatcattgaattaaaacacaaagcaagagaaaaaccttatgatgttcaaagtttgcggactgcacttgaggaggcgatcaaaacgcgttatcaactggatccaaaatttatcacaaatattttgtatgaggataatgttatcactattgatctggttcaaaattcttctcagaaaactcagaatgatgtggacatagctgatgtggcttattattttgaaaaagatgttaaaggtgaatccttgtttcattctaagaaaatggacctgagagtaaatggggaacaactggatctggatcctggtcaaactttaatttattatgtcgatgaaaaagcacctgaattctcaatgcagggtctaaaagctggtgttattgctgttattgtggttgtggtgatagcaattgttgctggaattgttgtgctggttatttccagaaagaagagaatggcaaagtatgagaaggctgagataaaggagatgggtgagatgcatagggaactcaatgca

SEQ ID NO: 199 - protein, 333 aa, artificial
  swine 1-27 CD3 epsilon-EpCAM
QEDIERPDEDTQKTFKVSISGDKVELTDYKDDDDKTASFAAAQKECVCENYKLAVNCFLNDNGQCQCTSIGAQNTVLCSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDVQSLRTALEEAIKTRYQLDPKFITNILYEDNVITIDLVQNSSQKTQNDVDIADVAYYFEKDVKGESLFHSKKMDLRVNGEQLDLDPGQTLIYYVDEKAPEFSMQGLKAGVIAVIVVVVIAIVAGIVVLVISRKKRMAKYEKAEIKEMGEMHRELNA

SEQ ID NO: 200 - DNA, 1056 bp, artificial
  swine 1-27 CD3 epsilon-EpCAM
atgggatggagctgtatcatcctcttcttggtagcaacagctacaggtgtacactcccaagaagacattgaaagaccagatgaagatacacagaaaacatttaaagtctccatctctggagacaaagtagagctgacagattacaaggacgacgatgacaagactgcgagttttgccgcagctcagaaagaatgtgtctgtgaaaactacaagctggccgtaaactgctttttgaatgacaatggtcaatgccagtgtacttcgattggtgcacaaaatactgtcctttgctcaaagctggctgccaaatgtttggtgatgaaggcagaaatgaacggctcaaaacttgggagaagagcgaaacctgaaggggctctccagaacaatgatggcctttacgatcctgactgcgatgagagcgggctctttaaggccaagcagtgcaacggcacctccacgtgctggtgtgtgaacactgctggggtcagaagaactgacaaggacactgaaataacctgctctgagcgagtgagaacctactggatcatcattgaattaaaacacaaagcaagagaaaaaccttatgatgttcaaagtttgcggactgcacttgaggaggcgatcaaaacgcgttatcaactggatccaaaatttatcacaaatattttgtatgaggataatgttatcactattgatctggttcaaaattcttctcagaaaactcagaatgatgtggacatagctgatgtggcttattattttgaaaaagatgttaaaggtgaatccttgtttcattctaagaaaatggacctgagagtaaatggggaacaactggatctggatcctggtcaaactttaatttattatgtcgatgaaaaagcacctgaattctcaatgcagggtctaaaagctggtgttattgctgttattgtggttgtggtgatagcaattgttgctggaattgttgtgctggttatttccagaaagaagagaatggcaaagtatgagaaggctgagataaaggagatgggtgagatgcatagggaactcaatgca

SEQ ID NO: 201 - protein, 186 aa, Homo sapiens
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 202 - DNA, 621 bp, Homo sapiens
atgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcacgcgtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatc

SEQ ID NO: 203 - protein, 19 aa, artificial
  immunoglobulin leader peptide
MGWSCIILFLVATATGVHS

SEQ ID NO: 204 - DNA, 57 bp, artificial
  immunoglobulin leader peptide
atgggatggagctgtatcatcctcttcttggtagcaacagctacaggtgtacactcc

SEQ ID NO: 205 - protein, 324 aa, Mus sp.
AKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 206 - DNA, 972 bp, Mus sp.
gccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 207 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 208 - DNA, 318 bp, Homo sapiens
ggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 209 - DNA, 843 bp, artificial
  1-27 CD3-Fc + leader
atgggatggagctgtatcatcctcttcttggtagcaacagctacaggtgtacactcccaagatggtaatgaagaaatgggtggtattacacagacaccatataaagtctccatctctggaaccacagtaatattgacatccggagagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatag

SEQ ID NO: 210 - protein, 280 aa, artificial
  1-27 CD3-Fc + leader
MGWSCIILFLVATATGVHSQDGNEEMGGITQTPYKVSISGTTVILTSGEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 211 - protein, 8 aa, Homo sapiens
QDGNEEMG

SEQ ID NO: 212 - protein, 8 aa, Saimiri sciureus
QDGNEEIG

SEQ ID NO: 213 - DNA, 21 bp, artificial
  forward primer
cactgtggcccaggttcgagg

SEQ ID NO: 214 - DNA, 25 bp, artificial
  reverse primer
gacataccacacaaattcaatacgg

SEQ ID NO: 215 - DNA, 23 bp, artificial
  forward primer
gctctgctcgcgccgagatgtgg

SEQ ID NO: 216 - DNA, 21 bp, artificial
  reverse primer
acgctggacaccacctccagg

SEQ ID NO: 217 - DNA, 22 bp, artificial
  forward primer
ggttctactgagtgggcagagg

SEQ ID NO: 218 - DNA, 22 bp, artificial
  reverse primer
acttgttgtggctgcttggagc

SEQ ID NO: 219 - DNA, 22 bp, artificial
  forward primer
gggtgaagtcctatccagatgg

SEQ ID NO: 220 - DNA, 22 bp, artificial
  reverse primer
gtgctctgcctgaagcaattcc

SEQ ID NO: 221 - DNA, 21 bp, artificial
  forward primer
ctcggcttcctcttcgggtgg

SEQ ID NO: 222 - DNA, 26 bp, artificial
  reverse primer
gcatattcatttgctgggtaacctgg

SEQ ID NO: 223 - DNA, 2253 bp, artificial
  macaque PSMA (Cynomolgus)
atgtggaatctcctgcacgaaaccgactcggctgtggccaccgcgcgccgcccgcgctggctgtgcgctggggcactggtgctggcgggtggcttctttctcctcggcttcctcttcggatggtttataaaatcctccagtgaagctactaacattactccaaagcataatatgaaagcatttttggatgaactgaaagctgagaacatcaagaagttcttacataattttacacagataccacatttagcaggaacagaacaaaactttcaacttgcaaagcaaattcaatcccagtggaaagaatttggcctggattctgttgagctaactcattatgatgtcctgttgtcctacccaaataagactcatcccaactacatctcaataattaatgaagatggaaatgagattttcaacacatcattatttgaaccacctcctgcaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccacaggagtcattctctactcagaccctgctgactactttgctcctggggtaaagtcttatccagatggttggaatcttcctggaggtggtgtccagcgtggaaatatcctaaatctgaatggtgcaggagaccctctcacaccaggttacccagcaaatgaatatgcttataggcgtggaatggcagaggctgttggtcttccaagtattcccgttcatccaattgggtactatgatgcacagaagctcctagaaaaaatgggtggctcagcatcaccagatagcagctggagaggaagtctcaaagtgccctacaatgttggacctggctttactggaaacttttctacacaaaaagtcaagatgcacatccactctaccagtgaagtgacaagaatttacaatgtgataggtactctcagaggagcagtggaaccagacagatacgtcattctgggaggtcaccgggactcatgggtgtttggtggtattgaccctcagagtggagcagctgttgttcatgaaattgtgaggagctttggaacgctgaaaaaggaagggtggagacctagaagaacaattttgtttgcaagctgggatgcagaagaatttggtcttcttggttctactgaatgggcagaggagaattcaagactccttcaagagcgtggcgtggcttatattaatgctgattcgtctatagagggaaactacactctgagagttgattgtacaccactgatgtacagcttggtatacaacctaacaaaagagctggaaagccctgatgaaggctttgaaggcaaatctctttatgaaagttggactaaaaaaagtccttcccccgagttcagtggcatgcccaggataagcaaattgggatctggaaatgattttgaggtgttcttccaacgacttggaattgcctcaggcagagcacggtatactaaaaattgggaaacaaacaaattcagcagctatccactgtatcacagtgtctatgagacatatgagttggtggaaaagttttatgatccaatgtttaaatatcacctcactgtggcccaggttcgaggagggatggtgtttgaactagccaattccgtagtgctcccttttgattgtcgagattatgctgtagttttaagaaagtatgctgacaaaatctacaatatttctatgaaacatccacaggaaatgaagacatacagtgtatcatttgattcacttttttctgcagtaaagaattttacagaaattgcttccaagttcagcgagagactccgggactttgacaaaagcaacccaatattattaagaatgatgaatgatcaactcatgtttctggaaagagcatttattgatccattagggttaccagacagacctttttataggcatgtcatctatgctccaagcagccacaacaagtatgcaggggagtcattcccaggaatttatgatgctctgtttgatatcgaaagcaaagtggacccttcccaggcctggggagaagtgaagagacagatttctgttgcaaccttcacagtgcaagcagctgcagagactttgagtgaagtggcctaa

SEQ ID NO: 224 - protein, 750 aa, artificial
  macaque PSMA (Cynomolgus)
MWNLLHETDSAVATARRPRWLCAGALVLAGGFFLLGFLFGWFIKSSSEATNITPKHNMKAFLDELKAENIKKFLHNFTQIPHLAGTEQNFQLAKQIQSQWKEFGLDSVELTHYDVLLSYPNKTHPNYISIINEDGNEIFNTSLFEPPPAGYENVSDIVPPFSAFSPQGMPEGDLVYVNYARTEDFFKLERDMKINCSGKIVIARYGKVFRGNKVKNAQLAGATGVILYSDPADYFAPGVKSYPDGWNLPGGGVQRGNILNLNGAGDPLTPGYPANEYAYRRGMAEAVGLPSIPVHPIGYYDAQKLLEKMGGSASPDSSWRGSLKVPYNVGPGFTGNFSTQKVKMHIHSTSEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVYNLTKELESPDEGFEGKSLYESWTKKSPSPEFSGMPRISKLGSGNDFEVFFQRLGIASGRARYTKNWETNKFSSYPLYHSVYETYELVEKFYDPMFKYHLTVAQVRGGMVFELANSVVLPFDCRDYAVVLRKYADKIYNISMKHPQEMKTYSVSFDSLFSAVKNFTEIASKFSERLRDFDKSNPILLRMMNDQLMFLERAFIDPLGLPDRPFYRHVIYAPSSHNKYAGESFPGIYDALFDIESKVDPSQAWGEVKRQISVATFTVQAAAETLSEVA

SEQ ID NO: 225 - protein, 120 aa, artificial
  PM52C3-VH
QVQLVQSGAEVKKPGASVKLSCKASGYTFTYFDINWVRQTPEQGLEWMGGISPGDGNTNYNENFKGRVTMTRDTSSSTAYMELSRLRSDDTAVYYCARDGNFPYYAMDSWGQGTTVTVSS

SEQ ID NO: 226 - protein, 5 aa, artificial
  PM52C3-HCDR1
YFDIN

SEQ ID NO: 227 - protein, 17 aa, artificial
  PM52C3-HCDR2
GISPGDGNTNYNENFKG

SEQ ID NO: 228 - protein, 11 aa, artificial
  PM52C3-HCDR3
DGNFPYYAMDS

SEQ ID NO: 229 - DNA, 360 bp, artificial
  PM52C3-VH
caggtgcagctggtccagtctggcgccgaagtgaagaagcctggcgcctccgtgaagctgtcctgcaaggcctccggctacaccttcacctacttcgacatcaactgggtgcggcagacgcctgagcagggcctggaatggatgggcggcatctcccctggcgacggcaacaccaactacaacgagaacttcaagggcagggtcacaatgaccagagacacgtcctcatccaccgcctacatggagctgtcccggctgagatctgacgacaccgccgtgtactactgcgccagggacggcaacttcccttactacgccatggactcttggggccagggcaccacggtcaccgtctcctca

SEQ ID NO: 230 - protein, 112 aa, artificial
  PM52C3-VL
DVVMTQSPLSLPVTLGEPASISCRSSQSLVYSNGNTYLHWYQQKPGQSPRLLIYKVSNRFSGVPDRFSGSGSGTDFTLKISRVEAEDVGVYFCSQSTHVPYTFGQGTKLEIK

SEQ ID NO: 231 - protein, 16 aa, artificial
  PM52C3-LCDR1
RSSQSLVYSNGNTYLH

SEQ ID NO: 232 - protein, 7 aa, artificial
  PM52C3-LCDR2
KVSNRFS

SEQ ID NO: 233 - protein, 9 aa, artificial
  PM52C3-LCDR3
SQSTHVPYT

SEQ ID NO: 234 - DNA, 336 bp, artificial
  PM52C3-VL
gacgtcgtgatgactcagtctccactctccctgcccgtcacccttggagagccggcctccatctcctgcaggtctagtcaaagcctcgtatacagtaacggaaacacctacttgcattggtatcaacagaagccaggccaatctccaagactcctaatttataaggtttctaaccggttctctggggtcccagacagattcagcggcagtgggtcaggcactgatttcacactgaaaatcagcagggtggaggctgaggatgttggggtttatttctgctctcaaagtacacatgttccgtacacgtttggccaggggaccaagctggagatcaaa

SEQ ID NO: 235 - protein, 247 aa, artificial
  PM52C3-VH-VL
QVQLVQSGAEVKKPGASVKLSCKASGYTFTYFDINWVRQTPEQGLEWMGGISPGDGNTNYNENFKGRVTMTRDTSSSTAYMELSRLRSDDTAVYYCARDGNFPYYAMDSWGQGTTVTVSSGGGGSGGGGSGGGGSDVVMTQSPLSLPVTLGEPASISCRSSQSLVYSNGNTYLHWYQQKPGQSPRLLIYKVSNRFSGVPDRFSGSGSGTDFTLKISRVEAEDVGVYFCSQSTHVPYTFGQGTKLEIK

SEQ ID NO: 236 - DNA, 741 bp, artificial
  PM52C3-VH-VL
caggtgcagctggtccagtctggcgccgaagtgaagaagcctggcgcctccgtgaagctgtcctgcaaggcctccggctacaccttcacctacttcgacatcaactgggtgcggcagacgcctgagcagggcctggaatggatgggcggcatctcccctggcgacggcaacaccaactacaacgagaacttcaagggcagggtcacaatgaccagagacacgtcctcatccaccgcctacatggagctgtcccggctgagatctgacgacaccgccgtgtactactgcgccagggacggcaacttcccttactacgccatggactcttggggccagggcaccacggtcaccgtctcctcaggtggtggtggttctggcggcggcggctccggtggtggtggttctgacgtcgtgatgactcagtctccactctccctgcccgtcacccttggagagccggcctccatctcctgcaggtctagtcaaagcctcgtatacagtaacggaaacacctacttgcattggtatcaacagaagccaggccaatctccaagactcctaatttataaggtttctaaccggttctctggggtcccagacagattcagcggcagtgggtcaggcactgatttcacactgaaaatcagcagggtggaggctgaggatgttggggtttatttctgctctcaaagtacacatgttccgtacacgtttggccaggggaccaagctggagatcaaa

SEQ ID NO: 237 - protein, 502 aa, artificial
  PM52C3-VH-VL x I2C VH-VL
QVQLVQSGAEVKKPGASVKLSCKASGYTFTYFDINWVRQTPEQGLEWMGGISPGDGNTNYNENFKGRVTMTRDTSSSTAYMELSRLRSDDTAVYYCARDGNFPYYAMDSWGQGTTVTVSSGGGGSGGGGSGGGGSDVVMTQSPLSLPVTLGEPASISCRSSQSLVYSNGNTYLHWYQQKPGQSPRLLIYKVSNRFSGVPDRFSGSGSGTDFTLKISRVEAEDVGVYFCSQSTHVPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 238 - DNA, 1506 bp, artificial
  PM52C3-VH-VL x I2C VH-VL
caggtgcagctggtccagtctggcgccgaagtgaagaagcctggcgcctccgtgaagctgtcctgcaaggcctccggctacaccttcacctacttcgacatcaactgggtgcggcagacgcctgagcagggcctggaatggatgggcggcatctcccctggcgacggcaacaccaactacaacgagaacttcaagggcagggtcacaatgaccagagacacgtcctcatccaccgcctacatggagctgtcccggctgagatctgacgacaccgccgtgtactactgcgccagggacggcaacttcccttactacgccatggactcttggggccagggcaccacggtcaccgtctcctcaggtggtggtggttctggcggcggcggctccggtggtggtggttctgacgtcgtgatgactcagtctccactctccctgcccgtcacccttggagagccggcctccatctcctgcaggtctagtcaaagcctcgtatacagtaacggaaacacctacttgcattggtatcaacagaagccaggccaatctccaagactcctaatttataaggtttctaaccggttctctggggtcccagacagattcagcggcagtgggtcaggcactgatttcacactgaaaatcagcagggtggaggctgaggatgttggggtttatttctgctctcaaagtacacatgttccgtacacgtttggccaggggaccaagctggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 239 - protein, 120 aa, artificial
  PM52H3-VH
QVQLVQSGAEVKKPGASVKLSCKASGYTFTYFDINWVRQTPEQGLEWMGGISPGDGNTNYNENFKGRVTMTRDTSKSTAYMELSRLRSDDTAVYYCARDGNFPYYAMDSWGQGTTVTVSS

SEQ ID NO: 240 - protein, 5 aa, artificial
  PM52H3-HCDR1
YFDIN

SEQ ID NO: 241 - protein, 17 aa, artificial
  PM52H3-HCDR2
GISPGDGNTNYNENFKG

SEQ ID NO: 242 - protein, 11 aa, artificial
  PM52H3-HCDR3
DGNFPYYAMDS

SEQ ID NO: 243 - DNA, 360 bp, artificial
  PM52H3-VH
caggtgcagctggtccagtctggcgccgaagtgaagaagcctggcgcctccgtgaagctgtcctgcaaggcctccggctacaccttcacctacttcgacatcaactgggtgcggcagacgcctgagcagggcctggaatggatgggcggcatctcccctggcgacggcaacaccaactacaacgagaacttcaagggcagggtcacaatgaccagagacacgtccaaatccaccgcctacatggagctgtcccggctgagatctgacgacaccgccgtgtactactgcgccagggacggcaacttcccttactacgccatggactcttggggccagggcaccacggtcaccgtctcctca

SEQ ID NO: 244 - protein, 112 aa, artificial; identical to SEQ ID NO: 230
  PM52H3-VL

SEQ ID NO: 245 - protein, 16 aa, artificial
  PM52H3-LCDR1
RSSQSLVYSNGNTYLH

SEQ ID NO: 246 - protein, 7 aa, artificial
  PM52H3-LCDR2
KVSNRFS

SEQ ID NO: 247 - protein, 9 aa, artificial
  PM52H3-LCDR3
SQSTHVPYT

SEQ ID NO: 248 - DNA, 336 bp, artificial; identical to SEQ ID NO: 234
  PM52H3-VL

SEQ ID NO: 249 - protein, 247 aa, artificial
  PM52H3-VH-VL
QVQLVQSGAEVKKPGASVKLSCKASGYTFTYFDINWVRQTPEQGLEWMGGISPGDGNTNYNENFKGRVTMTRDTSKSTAYMELSRLRSDDTAVYYCARDGNFPYYAMDSWGQGTTVTVSSGGGGSGGGGSGGGGSDVVMTQSPLSLPVTLGEPASISCRSSQSLVYSNGNTYLHWYQQKPGQSPRLLIYKVSNRFSGVPDRFSGSGSGTDFTLKISRVEAEDVGVYFCSQSTHVPYTFGQGTKLEIK

SEQ ID NO: 250 - DNA, 741 bp, artificial
  PM52H3-VH-VL
caggtgcagctggtccagtctggcgccgaagtgaagaagcctggcgcctccgtgaagctgtcctgcaaggcctccggctacaccttcacctacttcgacatcaactgggtgcggcagacgcctgagcagggcctggaatggatgggcggcatctcccctggcgacggcaacaccaactacaacgagaacttcaagggcagggtcacaatgaccagagacacgtccaaatccaccgcctacatggagctgtcccggctgagatctgacgacaccgccgtgtactactgcgccagggacggcaacttcccttactacgccatggactcttggggccagggcaccacggtcaccgtctcctcaggtggtggtggttctggcggcggcggctccggtggtggtggttctgacgtcgtgatgactcagtctccactctccctgcccgtcacccttggagagccggcctccatctcctgcaggtctagtcaaagcctcgtatacagtaacggaaacacctacttgcattggtatcaacagaagccaggccaatctccaagactcctaatttataaggtttctaaccggttctctggggtcccagacagattcagcggcagtgggtcaggcactgatttcacactgaaaatcagcagggtggaggctgaggatgttggggtttatttctgctctcaaagtacacatgttccgtacacgtttggccaggggaccaagctggagatcaaa

SEQ ID NO: 251 - protein, 502 aa, artificial
  PM52H3-VH-VL x I2C VH-VL
QVQLVQSGAEVKKPGASVKLSCKASGYTFTYFDINWVRQTPEQGLEWMGGISPGDGNTNYNENFKGRVTMTRDTSKSTAYMELSRLRSDDTAVYYCARDGNFPYYAMDSWGQGTTVTVSSGGGGSGGGGSGGGGSDVVMTQSPLSLPVTLGEPASISCRSSQSLVYSNGNTYLHWYQQKPGQSPRLLIYKVSNRFSGVPDRFSGSGSGTDFTLKISRVEAEDVGVYFCSQSTHVPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 252 - DNA, 1506 bp, artificial
  PM52H3-VH-VL x I2C VH-VL
caggtgcagctggtccagtctggcgccgaagtgaagaagcctggcgcctccgtgaagctgtcctgcaaggcctccggctacaccttcacctacttcgacatcaactgggtgcggcagacgcctgagcagggcctggaatggatgggcggcatctcccctggcgacggcaacaccaactacaacgagaacttcaagggcagggtcacaatgaccagagacacgtccaaatccaccgcctacatggagctgtcccggctgagatctgacgacaccgccgtgtactactgcgccagggacggcaacttcccttactacgccatggactcttggggccagggcaccacggtcaccgtctcctcaggtggtggtggttctggcggcggcggctccggtggtggtggttctgacgtcgtgatgactcagtctccactctccctgcccgtcacccttggagagccggcctccatctcctgcaggtctagtcaaagcctcgtatacagtaacggaaacacctacttgcattggtatcaacagaagccaggccaatctccaagactcctaatttataaggtttctaaccggttctctggggtcccagacagattcagcggcagtgggtcaggcactgatttcacactgaaaatcagcagggtggaggctgaggatgttggggtttatttctgctctcaaagtacacatgttccgtacacgtttggccaggggaccaagctggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 253 - protein, 120 aa, artificial
  PM75A10-VH
QVQLVQSGAEVKKPGASVKLSCKASGYTFTYFDINWVRQTPEQGLEWMGGISPGDGNTNYNENFKGRVTMTRDTSSSTAYMELSRLRSDDTAVYYCARDGNFPYYAMVNWGQGTTVTVSS

SEQ ID NO: 254 - protein, 5 aa, artificial
  PM75A10-HCDR1
YFDIN

SEQ ID NO: 255 - protein, 17 aa, artificial
  PM75A10-HCDR2
GISPGDGNTNYNENFKG

SEQ ID NO: 256 - protein, 11 aa, artificial
  PM75A10-HCDR3
DGNFPYYAMVN

SEQ ID NO: 257 - DNA, 360 bp, artificial
  PM75A10-VH
caggtgcagctggtccagtctggcgccgaagtgaagaagcctggcgcctccgtgaagctgtcctgcaaggcctccggctacaccttcacctacttcgacatcaactgggtgcggcagacgcctgagcagggcctggaatggatgggcggcatctcccctggcgacggcaacaccaactacaacgagaacttcaagggcagggtcacaatgaccagagacacgtcctcatccaccgcctacatggagctgtcccggctgagatctgacgacaccgccgtgtactactgcgccagggacggcaacttcccttactacgcgatggtcaactggggccagggcaccacggtcaccgtctcctca

SEQ ID NO: 258 - protein, 112 aa, artificial; identical to SEQ ID NO: 230
  PM75A10-VL

SEQ ID NO: 259 - protein, 16 aa, artificial
  PM75A10-LCDR1
RSSQSLVYSNGNTYLH

SEQ ID NO: 260 - protein, 7 aa, artificial
  PM75A10-LCDR2
KVSNRFS

SEQ ID NO: 261 - protein, 9 aa, artificial
  PM75A10-LCDR3
SQSTHVPYT

SEQ ID NO: 262 - DNA, 336 bp, artificial
  PM75A10-VL
gacgtcgtgatgactcagtctccactctccctgcccgtcacccttggagagccggcctccatctcctgcaggtctagtcaaagcctcgtatacagtaacggaaacacctacttgcattggtatcaacagaagccaggccaatctccaagactcctaatttataaggtttctaaccggttctctggggtcccagacagattcagcggcagtgggtcaggcactgatttcacactgaaaatcagcagggtggaggctgaggatgttggggtttatttctgttctcaaagtacacatgttccgtacacgtttggccaggggaccaagctggagatcaaa

SEQ ID NO: 263 - protein, 247 aa, artificial
  PM75A10-VH-VL
QVQLVQSGAEVKKPGASVKLSCKASGYTFTYFDINWVRQTPEQGLEWMGGISPGDGNTNYNENFKGRVTMTRDTSSSTAYMELSRLRSDDTAVYYCARDGNFPYYAMVNWGQGTTVTVSSGGGGSGGGGSGGGGSDVVMTQSPLSLPVTLGEPASISCRSSQSLVYSNGNTYLHWYQQKPGQSPRLLIYKVSNRFSGVPDRFSGSGSGTDFTLKISRVEAEDVGVYFCSQSTHVPYTFGQGTKLEIK

SEQ ID NO: 264 - DNA, 741 bp, artificial
  PM75A10-VH-VL
caggtgcagctggtccagtctggcgccgaagtgaagaagcctggcgcctccgtgaagctgtcctgcaaggcctccggctacaccttcacctacttcgacatcaactgggtgcggcagacgcctgagcagggcctggaatggatgggcggcatctcccctggcgacggcaacaccaactacaacgagaacttcaagggcagggtcacaatgaccagagacacgtcctcatccaccgcctacatggagctgtcccggctgagatctgacgacaccgccgtgtactactgcgccagggacggcaacttcccttactacgcgatggtcaactggggccagggcaccacggtcaccgtctcctcaggtggtggtggttctggcggcggcggctccggtggtggtggttctgacgtcgtgatgactcagtctccactctccctgcccgtcacccttggagagccggcctccatctcctgcaggtctagtcaaagcctcgtatacagtaacggaaacacctacttgcattggtatcaacagaagccaggccaatctccaagactcctaatttataaggtttctaaccggttctctggggtcccagacagattcagcggcagtgggtcaggcactgatttcacactgaaaatcagcagggtggaggctgaggatgttggggtttatttctgttctcaaagtacacatgttccgtacacgtttggccaggggaccaagctggagatcaaa

SEQ ID NO: 265 - protein, 502 aa, artificial
  PM75A10-Vh-VL x I2C VH-VL
QVQLVQSGAEVKKPGASVKLSCKASGYTFTYFDINWVRQTPEQGLEWMGGISPGDGNTNYNENFKGRVTMTRDTSSSTAYMELSRLRSDDTAVYYCARDGNFPYYAMVNWGQGTTVTVSSGGGGSGGGGSGGGGSDVVMTQSPLSLPVTLGEPASISCRSSQSLVYSNGNTYLHWYQQKPGQSPRLLIYKVSNRFSGVPDRFSGSGSGTDFTLKISRVEAEDVGVYFCSQSTHVPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 266 - DNA, 1506 bp, artificial
  PM75A10-Vh-VL x I2C VH-VL
caggtgcagctggtccagtctggcgccgaagtgaagaagcctggcgcctccgtgaagctgtcctgcaaggcctccggctacaccttcacctacttcgacatcaactgggtgcggcagacgcctgagcagggcctggaatggatgggcggcatctcccctggcgacggcaacaccaactacaacgagaacttcaagggcagggtcacaatgaccagagacacgtcctcatccaccgcctacatggagctgtcccggctgagatctgacgacaccgccgtgtactactgcgccagggacggcaacttcccttactacgcgatggtcaactggggccagggcaccacggtcaccgtctcctcaggtggtggtggttctggcggcggcggctccggtggtggtggttctgacgtcgtgatgactcagtctccactctccctgcccgtcacccttggagagccggcctccatctcctgcaggtctagtcaaagcctcgtatacagtaacggaaacacctacttgcattggtatcaacagaagccaggccaatctccaagactcctaatttataaggtttctaaccggttctctggggtcccagacagattcagcggcagtgggtcaggcactgatttcacactgaaaatcagcagggtggaggctgaggatgttggggtttatttctgttctcaaagtacacatgttccgtacacgtttggccaggggaccaagctggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 267 - protein, 120 aa, artificial
  PM91B6-VH
QVQLVQSGAEVKKPGASVKLSCKASGYTFTYFDINWVRQTPEQGLEWMGGISPGDGNTNYNENFKGRVTMTRDTSSSTAYMELSRLRSDDTAVYYCARDGNFPYYALTNWGQGTTVTVSS

SEQ ID NO: 268 - protein, 5 aa, artificial
  PM91B6-HCDR1
YFDIN

SEQ ID NO: 269 - protein, 17 aa, artificial
  PM91B6-HCDR2
GISPGDGNTNYNENFKG

SEQ ID NO: 270 - protein, 11 aa, artificial
  PM91B6-HCDR3
DGNFPYYALTN

SEQ ID NO: 271 - DNA, 360 bp, artificial
  PM91B6-VH
caggtgcagctggtccagtctggcgccgaagtgaagaagcctggcgcctccgtgaagctgtcctgcaaggcctccggctacaccttcacctacttcgacatcaactgggtgcggcagacgcctgagcagggcctggaatggatgggcggcatctcccctggcgacggcaacaccaactacaacgagaacttcaagggcagggtcacaatgaccagagacacgtcctcatccaccgcctacatggagctgtcccggctgagatctgacgacaccgccgtgtactactgcgccagggacggcaacttcccttactacgccctgaccaactggggccagggcaccacggtcaccgtctcctca

SEQ ID NO: 272 - protein, 112 aa, artificial; identical to SEQ ID NO: 230
  PM91B6-VL

SEQ ID NO: 273 - protein, 16 aa, artificial
  PM91B6-LCDR1
RSSQSLVYSNGNTYLH

SEQ ID NO: 274 - protein, 7 aa, artificial
  PM91B6-LCDR2
KVSNRFS

SEQ ID NO: 275 - protein, 9 aa, artificial
  PM91B6-LCDR3
SQSTHVPYT

SEQ ID NO: 276 - DNA, 336 bp, artificial; identical to SEQ ID NO: 262
  PM91B6-VL

SEQ ID NO: 277 - protein, 247 aa, artificial
  PM91B6-VH-VL
QVQLVQSGAEVKKPGASVKLSCKASGYTFTYFDINWVRQTPEQGLEWMGGISPGDGNTNYNENFKGRVTMTRDTSSSTAYMELSRLRSDDTAVYYCARDGNFPYYALTNWGQGTTVTVSSGGGGSGGGGSGGGGSDVVMTQSPLSLPVTLGEPASISCRSSQSLVYSNGNTYLHWYQQKPGQSPRLLIYKVSNRFSGVPDRFSGSGSGTDFTLKISRVEAEDVGVYFCSQSTHVPYTFGQGTKLEIK

SEQ ID NO: 278 - DNA, 741 bp, artificial
  PM91B6-VH-VL
caggtgcagctggtccagtctggcgccgaagtgaagaagcctggcgcctccgtgaagctgtcctgcaaggcctccggctacaccttcacctacttcgacatcaactgggtgcggcagacgcctgagcagggcctggaatggatgggcggcatctcccctggcgacggcaacaccaactacaacgagaacttcaagggcagggtcacaatgaccagagacacgtcctcatccaccgcctacatggagctgtcccggctgagatctgacgacaccgccgtgtactactgcgccagggacggcaacttcccttactacgccctgaccaactggggccagggcaccacggtcaccgtctcctcaggtggtggtggttctggcggcggcggctccggtggtggtggttctgacgtcgtgatgactcagtctccactctccctgcccgtcacccttggagagccggcctccatctcctgcaggtctagtcaaagcctcgtatacagtaacggaaacacctacttgcattggtatcaacagaagccaggccaatctccaagactcctaatttataaggtttctaaccggttctctggggtcccagacagattcagcggcagtgggtcaggcactgatttcacactgaaaatcagcagggtggaggctgaggatgttggggtttatttctgttctcaaagtacacatgttccgtacacgtttggccaggggaccaagctggagatcaaa

SEQ ID NO: 279 - protein, 502 aa, artificial
  PM91B6-VH-VL x I2C VH-VL
QVQLVQSGAEVKKPGASVKLSCKASGYTFTYFDINWVRQTPEQGLEWMGGISPGDGNTNYNENFKGRVTMTRDTSSSTAYMELSRLRSDDTAVYYCARDGNFPYYALTNWGQGTTVTVSSGGGGSGGGGSGGGGSDVVMTQSPLSLPVTLGEPASISCRSSQSLVYSNGNTYLHWYQQKPGQSPRLLIYKVSNRFSGVPDRFSGSGSGTDFTLKISRVEAEDVGVYFCSQSTHVPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 280 - DNA, 1506 bp, artificial
  PM91B6-VH-VL x I2C VH-VL
caggtgcagctggtccagtctggcgccgaagtgaagaagcctggcgcctccgtgaagctgtcctgcaaggcctccggctacaccttcacctacttcgacatcaactgggtgcggcagacgcctgagcagggcctggaatggatgggcggcatctcccctggcgacggcaacaccaactacaacgagaacttcaagggcagggtcacaatgaccagagacacgtcctcatccaccgcctacatggagctgtcccggctgagatctgacgacaccgccgtgtactactgcgccagggacggcaacttcccttactacgccctgaccaactggggccagggcaccacggtcaccgtctcctcaggtggtggtggttctggcggcggcggctccggtggtggtggttctgacgtcgtgatgactcagtctccactctccctgcccgtcacccttggagagccggcctccatctcctgcaggtctagtcaaagcctcgtatacagtaacggaaacacctacttgcattggtatcaacagaagccaggccaatctccaagactcctaatttataaggtttctaaccggttctctggggtcccagacagattcagcggcagtgggtcaggcactgatttcacactgaaaatcagcagggtggaggctgaggatgttggggtttatttctgttctcaaagtacacatgttccgtacacgtttggccaggggaccaagctggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 281 - protein, 121 aa, artificial
  PM83A12-VH
QVQLVESGGGLVKPGESLRLSCAASGFTFSDYYMYWVRQAPGKGLEWVAIISDGGYYTYYSDIIKGRFTISRDNAKNSLYLQTNSLKAEDTAVYYCARGFPLLRHGAFDLWGQGTLVTVSS

SEQ ID NO: 282 - protein, 5 aa, artificial
  PM83A12-HCDR1
DYYMY

SEQ ID NO: 283 - protein, 17 aa, artificial
  PM83A12-HCDR2
IISDGGYYTYYSDIIKG

SEQ ID NO: 284 - protein, 12 aa, artificial
  PM83A12-HCDR3
GFPLLRHGAFDL

SEQ ID NO: 285 - DNA, 363 bp, artificial
  PM83A12-VH
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggccatcatctccgacggcggctactacacctactactccgacatcatcaagggccggttcaccatctcccgggacaatgccaagaacagcctgtacctgcagacgaactccctgaaggccgaggacaccgccgtgtactactgcgcccggggcttccctctgctgagacacggcgccttcgacctctggggccagggcaccctggtcaccgtctcctca

SEQ ID NO: 286 - protein, 107 aa, artificial
  PM83A12-VL
DIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 287 - protein, 11 aa, artificial
  PM83A12-LCDR1
KASQNVDTNVA

SEQ ID NO: 288 - protein, 7 aa, artificial
  PM83A12-LCDR2
SASYRYS

SEQ ID NO: 289 - protein, 9 aa, artificial
  PM83A12-LCDR3
QQYDSYPYT

SEQ ID NO: 290 - DNA, 321 bp, artificial
  PM83A12-VL
gacatccagatgacccagtcccccagctccctgtccgcctccgtgggcgacagagtgaccatcacctgcaaggcctcccagaacgtggacaccaacgtggcctggtatcagcagaagcccggccaggcccctaagtccctgatctactccgcctcctaccggtactctgacgtgccttcccggttctccggctccgcgtccggcaccgacttcaccctgaccatctccagcgtgcagtctgaggacttcgccacgtactactgccagcagtacgactcctacccttacaccttcggcggagggaccaagctggaaatcaag

SEQ ID NO: 291 - protein, 243 aa, artificial
  PM83A12-VH-VL
QVQLVESGGGLVKPGESLRLSCAASGFTFSDYYMYWVRQAPGKGLEWVAIISDGGYYTYYSDIIKGRFTISRDNAKNSLYLQTNSLKAEDTAVYYCARGFPLLRHGAFDLWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 292 - DNA, 729 bp, artificial
  PM83A12-VH-VL
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggccatcatctccgacggcggctactacacctactactccgacatcatcaagggccggttcaccatctcccgggacaatgccaagaacagcctgtacctgcagacgaactccctgaaggccgaggacaccgccgtgtactactgcgcccggggcttccctctgctgagacacggcgccttcgacctctggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcaaggcctcccagaacgtggacaccaacgtggcctggtatcagcagaagcccggccaggcccctaagtccctgatctactccgcctcctaccggtactctgacgtgccttcccggttctccggctccgcgtccggcaccgacttcaccctgaccatctccagcgtgcagtctgaggacttcgccacgtactactgccagcagtacgactcctacccttacaccttcggcggagggaccaagctggaaatcaag

SEQ ID NO: 293 - protein, 498 aa, artificial
  PM83A12-VH-VL x I2C VH-VL
QVQLVESGGGLVKPGESLRLSCAASGFTFSDYYMYWVRQAPGKGLEWVAIISDGGYYTYYSDIIKGRFTISRDNAKNSLYLQTNSLKAEDTAVYYCARGFPLLRHGAFDLWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 294 - DNA, 1494 bp, artificial
  PM83A12-VH-VL x I2C VH-VL
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggccatcatctccgacggcggctactacacctactactccgacatcatcaagggccggttcaccatctcccgggacaatgccaagaacagcctgtacctgcagacgaactccctgaaggccgaggacaccgccgtgtactactgcgcccggggcttccctctgctgagacacggcgccttcgacctctggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcaaggcctcccagaacgtggacaccaacgtggcctggtatcagcagaagcccggccaggcccctaagtccctgatctactccgcctcctaccggtactctgacgtgccttcccggttctccggctccgcgtccggcaccgacttcaccctgaccatctccagcgtgcagtctgaggacttcgccacgtactactgccagcagtacgactcctacccttacaccttcggcggagggaccaagctggaaatcaagtccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 295 - protein, 121 aa, artificial
  PM07F8MPF-VH
QVQLVESGGGLVKPGESLRLSCAASGFTFSDYYMYWVRQAPGKGLEWVASISDGGSNTYYSDIIKGRFTISRDNAKNSLYLQTNSLKAEDTAVYYCARGFPLLRHGAFDLWGQGTLVTVSS

SEQ ID NO: 296 - protein, 5 aa, artificial
  PM07F8MPF-HCDR1
DYYMY

SEQ ID NO: 297 - protein, 17 aa, artificial
  PM07F8MPF-HCDR2
SISDGGSNTYYSDIIKG

SEQ ID NO: 298 - protein, 12 aa, artificial
  PM07F8MPF-HCDR3
GFPLLRHGAFDL

SEQ ID NO: 299 - DNA, 363 bp, artificial
  PM07F8MPF-VH
caggtgcagctggtcgagtctggcggcggactggtgaagcctggcgagtccctgaggctgtcctgtgccgcctccggcttcaccttctccgactactacatgtactgggtccgccaggcccctgggaagggactggaatgggtggcctccatctccgacggcggctccaacacctactactccgacatcatcaagggccggttcaccatctcccgggacaacgccaagaacagcctgtacctgcagacgaactccctgaaggccgaggacaccgccgtgtactactgcgcccggggcttccctctgctgagacacggcgccttcgacctctggggccagggcaccctggtcaccgtctcctca

SEQ ID NO: 300 - protein, 107 aa, artificial
  PM07F8MPF-VL
DIQMTQSPSSLSASVGDRVTITCRASQNVDTNVAWYQQKPGQAPKSLIYSATYRYSDVPSRFSGSASGTDFTLTISSVQSEDFATYYCQQYNSYPYTFGGGTKLEIK

SEQ ID NO: 301 - protein, 11 aa, artificial
  PM07F8MPF-LCDR1
RASQNVDTNVA

SEQ ID NO: 302 - protein, 17 aa, artificial
  PM07F8MPF-LCDR2
ARTIFICIALSATYRYS

SEQ ID NO: 303 - protein, 9 aa, artificial
  PM07F8MPF-LCDR3
QQYNSYPYT

SEQ ID NO: 304 - DNA, 321 bp, artificial
  PM07F8MPF-VL
gacatccagatgacccagtcccccagctccctgtccgcctccgtgggcgacagagtgaccatcacctgcagggcctcccagaacgtggacaccaacgtggcctggtatcagcagaagcccggccaggcccctaagtccctgatctactccgccacctaccggtactctgacgtgccttcccggttctccggctccgcgtccggcaccgacttcaccctgaccatctccagcgtgcagtctgaggacttcgccacgtactactgccagcagtacaactcctacccttacaccttcggcggagggaccaagctggaaatcaag

SEQ ID NO: 305 - protein, 243 aa, artificial
  PM07F8MPF-VH-VL
QVQLVESGGGLVKPGESLRLSCAASGFTFSDYYMYWVRQAPGKGLEWVASISDGGSNTYYSDIIKGRFTISRDNAKNSLYLQTNSLKAEDTAVYYCARGFPLLRHGAFDLWGQGTLVTVSSGGGGSGGGGSGGGGSDIQMTQSPSSLSASVGDRVTITCRASQNVDTNVAWYQQKPGQAPKSLIYSATYRYSDVPSRFSGSASGTDFTLTISSVQSEDFATYYCQQYNSYPYTFGGGTKLEIK

SEQ ID NO: 306 - DNA, 729 bp, artificial
  PM07F8MPF-VH-VL
caggtgcagctggtcgagtctggcggcggactggtgaagcctggcgagtccctgaggctgtcctgtgccgcctccggcttcaccttctccgactactacatgtactgggtccgccaggcccctgggaagggactggaatgggtggcctccatctccgacggcggctccaacacctactactccgacatcatcaagggccggttcaccatctcccgggacaacgccaagaacagcctgtacctgcagacgaactccctgaaggccgaggacaccgccgtgtactactgcgcccggggcttccctctgctgagacacggcgccttcgacctctggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcagggcctcccagaacgtggacaccaacgtggcctggtatcagcagaagcccggccaggcccctaagtccctgatctactccgccacctaccggtactctgacgtgccttcccggttctccggctccgcgtccggcaccgacttcaccctgaccatctccagcgtgcagtctgaggacttcgccacgtactactgccagcagtacaactcctacccttacaccttcggcggagggaccaagctggaaatcaag

SEQ ID NO: 307 - protein, 498 aa, artificial
  PM07F8MPF-VH-VL x I2C VH-VL
QVQLVESGGGLVKPGESLRLSCAASGFTFSDYYMYWVRQAPGKGLEWVASISDGGSNTYYSDIIKGRFTISRDNAKNSLYLQTNSLKAEDTAVYYCARGFPLLRHGAFDLWGQGTLVTVSSGGGGSGGGGSGGGGSDIQMTQSPSSLSASVGDRVTITCRASQNVDTNVAWYQQKPGQAPKSLIYSATYRYSDVPSRFSGSASGTDFTLTISSVQSEDFATYYCQQYNSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 308 - DNA, 1494 bp, artificial
  PM07F8MPF-VH-VL x I2C VH-VL
caggtgcagctggtcgagtctggcggcggactggtgaagcctggcgagtccctgaggctgtcctgtgccgcctccggcttcaccttctccgactactacatgtactgggtccgccaggcccctgggaagggactggaatgggtggcctccatctccgacggcggctccaacacctactactccgacatcatcaagggccggttcaccatctcccgggacaacgccaagaacagcctgtacctgcagacgaactccctgaaggccgaggacaccgccgtgtactactgcgcccggggcttccctctgctgagacacggcgccttcgacctctggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcagggcctcccagaacgtggacaccaacgtggcctggtatcagcagaagcccggccaggcccctaagtccctgatctactccgccacctaccggtactctgacgtgccttcccggttctccggctccgcgtccggcaccgacttcaccctgaccatctccagcgtgcagtctgaggacttcgccacgtactactgccagcagtacaactcctacccttacaccttcggcggagggaccaagctggaaatcaagtccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 309 - protein, 121 aa, artificial
  PM07F8L1-VH
QVQLVESGGGLVKPGESLRLSCAASGFTFSDYYMYWVRQAPGKGLEWVASISDGGSNTYYSDIIKGRFTISRDNAKNSLYLQMNSLKAEDTAVYYCARGFPLLRHGAFDYWGQGTLVTVSS

SEQ ID NO: 310 - protein, 5 aa, artificial
  PM07F8L1-HCDR1
DYYMS

SEQ ID NO: 311 - protein, 17 aa, artificial
  PM07F8L1-HCDR2
SISDGGSNTYYSDIIKG

SEQ ID NO: 312 - protein, 12 aa, artificial
  PM07F8L1-HCDR3
GFPLLRHGAFDY

SEQ ID NO: 313 - DNA, 363 bp, artificial
  PM07F8L1-VH
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggcctccatctccgacggcggctccaacacctactactccgacatcatcaagggccggttcaccatctcccgggacaacgccaagaacagcctgtacctgcagatgaactccctgaaggccgaggacaccgccgtgtactactgcgcccggggcttccctctgctgagacacggcgccttcgattactggggccagggcaccctggtcaccgtctcctca

SEQ ID NO: 314 - protein, 107 aa, artificial
  PM07F8L1-VL
DIQMTQSPSSLSASVGDRVTITCKASQNVDTNVAWYQQKPGQAPKSLIYSATYRYSDVPSRFSGSASGTDFTLTISSVQSEDFATYYCQQYNSYPYTFGGGTKLEIK

SEQ ID NO: 315 - protein, 11 aa, artificial
  PM07F8L1-LCDR1
KASQNVDTNVA

SEQ ID NO: 316 - protein, 7 aa, artificial
  PM07F8L1-LCDR2
SATYRYS

SEQ ID NO: 317 - protein, 9 aa, artificial
  PM07F8L1-LCDR3
QQYNSYPYT

SEQ ID NO: 318 - DNA, 321 bp, artificial
  PM07F8L1-VL
gacatccagatgacccagtcccccagctccctgtccgcctccgtgggcgacagagtgaccatcacctgcaaggcctcccagaacgtggacaccaacgtggcctggtatcagcagaagcccggccaggcccctaagtccctgatctactccgccacctaccggtactctgacgtgccttcccggttctccggctccgcgtccggcaccgacttcaccctgaccatctccagcgtgcagtctgaggacttcgccacgtactactgccagcagtacaactcctacccttacaccttcggcggagggaccaagctggaaatcaag

SEQ ID NO: 319 - protein, 243 aa, artificial
  PM07F8L1-VH-VL
QVQLVESGGGLVKPGESLRLSCAASGFTFSDYYMYWVRQAPGKGLEWVASISDGGSNTYYSDIIKGRFTISRDNAKNSLYLQMNSLKAEDTAVYYCARGFPLLRHGAFDYWGQGTLVTVSSGGGGSGGGGSGGGGSDIQMTQSPSSLSASVGDRVTITCKASQNVDTNVAWYQQKPGQAPKSLIYSATYRYSDVPSRFSGSASGTDFTLTISSVQSEDFATYYCQQYNSYPYTFGGGTKLEIK

SEQ ID NO: 320 - DNA, 729 bp, artificial
  PM07F8L1-VH-VL
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggcctccatctccgacggcggctccaacacctactactccgacatcatcaagggccggttcaccatctcccgggacaacgccaagaacagcctgtacctgcagatgaactccctgaaggccgaggacaccgccgtgtactactgcgcccggggcttccctctgctgagacacggcgccttcgattactggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcaaggcctcccagaacgtggacaccaacgtggcctggtatcagcagaagcccggccaggcccctaagtccctgatctactccgccacctaccggtactctgacgtgccttcccggttctccggctccgcgtccggcaccgacttcaccctgaccatctccagcgtgcagtctgaggacttcgccacgtactactgccagcagtacaactcctacccttacaccttcggcggagggaccaagctggaaatcaag

SEQ ID NO: 321 - protein, 498 aa, artificial
  PM07F8L1-VH-VL x I2C VH-VL
QVQLVESGGGLVKPGESLRLSCAASGFTFSDYYMYWVRQAPGKGLEWVASISDGGSNTYYSDIIKGRFTISRDNAKNSLYLQMNSLKAEDTAVYYCARGFPLLRHGAFDYWGQGTLVTVSSGGGGSGGGGSGGGGSDIQMTQSPSSLSASVGDRVTITCKASQNVDTNVAWYQQKPGQAPKSLIYSATYRYSDVPSRFSGSASGTDFTLTISSVQSEDFATYYCQQYNSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 322 - DNA, 1493 bp, artificial
  PM07F8L1-VH-VL x I2C VH-VL
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggcctccatctccgacggcggctccaacacctactactccgacatcatcaagggccggttcaccatctcccgggacaacgccaagaacagcctgtacctgcagatgaactccctgaaggccgaggacaccgccgtgtactactgcgcccggggcttccctctgctgagacacggcgccttcgattactggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcaaggcctcccagaacgtggacaccaacgtggcctggtatcagcagaagcccggccaggcccctaagtccctgatctactccgccacctaccggtactctgacgtgccttcccggttctccggctccgcgtccggcaccgacttcaccctgaccatctccagcgtgcagtctgaggacttcgccacgtactactgccagcagtacaactcctacccttacaccttcggcggagggaccaagctggaaatcaagtccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtcct

SEQ ID NO: 323 - protein, 121 aa, artificial; identical to SEQ ID NO: 309
  PM07F8L2-VH

SEQ ID NO: 324 - protein, 5 aa, artificial
  PM07F8L2-HCDR1
DYYMS

SEQ ID NO: 325 - protein, 17 aa, artificial
  PM07F8L2-HCDR2
SISDGGSNTYYSDIIKG

SEQ ID NO: 326 - protein, 12 aa, artificial
  PM07F8L2-HCDR3
GFPLLRHGAFDY

SEQ ID NO: 327 - DNA, 363 bp, artificial; identical to SEQ ID NO: 313
  PM07F8L2-VH

SEQ ID NO: 328 - protein, 107 aa, artificial
  PM07F8L2-VL
DIQMTQSPSSLSASVGDRVTITCRASQNVDTNVAWYQQKPGQAPKSLIYSASYRYSDVPSRFSGSASGTDFTLTISSVQSEDFATYYCQQYNSYPYTFGGGTKLEIK

SEQ ID NO: 329 - protein, 11 aa, artificial
  PM07F8L2-LCDR1
RASQNVDTNVA

SEQ ID NO: 330 - protein, 7 aa, artificial
  PM07F8L2-LCDR2
SASYRYS

SEQ ID NO: 331 - protein, 9 aa, artificial
  PM07F8L2-LCDR3
QQYNSYPYT

SEQ ID NO: 332 - DNA, 321 bp, artificial
  PM07F8L2-VL
gacatccagatgacccagtcccccagctccctgtccgcctccgtgggcgacagagtgaccatcacctgcagggcctcccagaacgtggacaccaacgtggcctggtatcagcagaagcccggccaggcccctaagtccctgatctactccgcctcctaccggtactctgacgtgccttcccggttctccggctccgcgtccggcaccgacttcaccctgaccatctccagcgtgcagtctgaggacttcgccacgtactactgccagcagtacaactcctacccttacaccttcggcggagggaccaagctggaaatcaag

SEQ ID NO: 333 - protein, 243 aa, artificial
  PM07F8L2-VH-VL
QVQLVESGGGLVKPGESLRLSCAASGFTFSDYYMYWVRQAPGKGLEWVASISDGGSNTYYSDIIKGRFTISRDNAKNSLYLQMNSLKAEDTAVYYCARGFPLLRHGAFDYWGQGTLVTVSSGGGGSGGGGSGGGGSDIQMTQSPSSLSASVGDRVTITCRASQNVDTNVAWYQQKPGQAPKSLIYSASYRYSDVPSRFSGSASGTDFTLTISSVQSEDFATYYCQQYNSYPYTFGGGTKLEIK

SEQ ID NO: 334 - DNA, 729 bp, artificial
  PM07F8L2-VH-VL
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggcctccatctccgacggcggctccaacacctactactccgacatcatcaagggccggttcaccatctcccgggacaacgccaagaacagcctgtacctgcagatgaactccctgaaggccgaggacaccgccgtgtactactgcgcccggggcttccctctgctgagacacggcgccttcgattactggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcagggcctcccagaacgtggacaccaacgtggcctggtatcagcagaagcccggccaggcccctaagtccctgatctactccgcctcctaccggtactctgacgtgccttcccggttctccggctccgcgtccggcaccgacttcaccctgaccatctccagcgtgcagtctgaggacttcgccacgtactactgccagcagtacaactcctacccttacaccttcggcggagggaccaagctggaaatcaag

SEQ ID NO: 335 - protein, 498 aa, artificial
  PM07F8L2-VH-VL x I2C VH-VL
QVQLVESGGGLVKPGESLRLSCAASGFTFSDYYMYWVRQAPGKGLEWVASISDGGSNTYYSDIIKGRFTISRDNAKNSLYLQMNSLKAEDTAVYYCARGFPLLRHGAFDYWGQGTLVTVSSGGGGSGGGGSGGGGSDIQMTQSPSSLSASVGDRVTITCRASQNVDTNVAWYQQKPGQAPKSLIYSASYRYSDVPSRFSGSASGTDFTLTISSVQSEDFATYYCQQYNSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 336 - DNA, 1493 bp, artificial
  PM07F8L2-VH-VL x I2C VH-VL
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggcctccatctccgacggcggctccaacacctactactccgacatcatcaagggccggttcaccatctcccgggacaacgccaagaacagcctgtacctgcagatgaactccctgaaggccgaggacaccgccgtgtactactgcgcccggggcttccctctgctgagacacggcgccttcgattactggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcagggcctcccagaacgtggacaccaacgtggcctggtatcagcagaagcccggccaggcccctaagtccctgatctactccgcctcctaccggtactctgacgtgccttcccggttctccggctccgcgtccggcaccgacttcaccctgaccatctccagcgtgcagtctgaggacttcgccacgtactactgccagcagtacaactcctacccttacaccttcggcggagggaccaagctggaaatcaagtccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtcct

SEQ ID NO: 337 - protein, 121 aa, artificial; identical to SEQ ID NO: 309
  PM07F8L3-VH

SEQ ID NO: 338 - protein, 5 aa, artificial
  PM07F8L3-HCDR1
DYYMS

SEQ ID NO: 339 - protein, 17 aa, artificial
  PM07F8L3-HCDR2
SISDGGSNTYYSDIIKG

SEQ ID NO: 340 - protein, 12 aa, artificial
  PM07F8L3-HCDR3
GFPLLRHGAFDY

SEQ ID NO: 341 - DNA, 363 bp, artificial; identical to SEQ ID NO: 313
  PM07F8L3-VH

SEQ ID NO: 342 - protein, 107 aa, artificial
  PM07F8L3-VL
DIQMTQSPSSLSASVGDRVTITCRASQNVDTNVAWYQQKPGQAPKSLIYSATYRYSDVPSRFSGSASGTDFTLTISSVQSEDFATYYCQQYDSYPYTFGGGTKLEIK

SEQ ID NO: 343 - protein, 11 aa, artificial
  PM07F8L3-LCDR1
RASQNVDTNVA

SEQ ID NO: 344 - protein, 7 aa, artificial
  PM07F8L3-LCDR2
SATYRYS

SEQ ID NO: 345 - protein, 9 aa, artificial
  PM07F8L3-LCDR3
QQYDSYPYT

SEQ ID NO: 346 - DNA, 321 bp, artificial
  PM07F8L3-VL
gacatccagatgacccagtcccccagctccctgtccgcctccgtgggcgacagagtgaccatcacctgcagggcctcccagaacgtggacaccaacgtggcctggtatcagcagaagcccggccaggcccctaagtccctgatctactccgccacctaccggtactctgacgtgccttcccggttctccggctccgcgtccggcaccgacttcaccctgaccatctccagcgtgcagtctgaggacttcgccacgtactactgccagcagtacgactcctacccttacaccttcggcggagggaccaagctggaaatcaag

SEQ ID NO: 347 - protein, 243 aa, artificial
  PM07F8L3-VH-VL
QVQLVESGGGLVKPGESLRLSCAASGFTFSDYYMYWVRQAPGKGLEWVASISDGGSNTYYSDIIKGRFTISRDNAKNSLYLQMNSLKAEDTAVYYCARGFPLLRHGAFDYWGQGTLVTVSSGGGGSGGGGSGGGGSDIQMTQSPSSLSASVGDRVTITCRASQNVDTNVAWYQQKPGQAPKSLIYSATYRYSDVPSRFSGSASGTDFTLTISSVQSEDFATYYCQQYDSYPYTFGGGTKLEIK

SEQ ID NO: 348 - DNA, 729 bp, artificial
  PM07F8L3-VH-VL
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggcctccatctccgacggcggctccaacacctactactccgacatcatcaagggccggttcaccatctcccgggacaacgccaagaacagcctgtacctgcagatgaactccctgaaggccgaggacaccgccgtgtactactgcgcccggggcttccctctgctgagacacggcgccttcgattactggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcagggcctcccagaacgtggacaccaacgtggcctggtatcagcagaagcccggccaggcccctaagtccctgatctactccgccacctaccggtactctgacgtgccttcccggttctccggctccgcgtccggcaccgacttcaccctgaccatctccagcgtgcagtctgaggacttcgccacgtactactgccagcagtacgactcctacccttacaccttcggcggagggaccaagctggaaatcaag

SEQ ID NO: 349 - protein, 498 aa, artificial
  PM07F8L3-VH-VL x I2C VH-VL
QVQLVESGGGLVKPGESLRLSCAASGFTFSDYYMYWVRQAPGKGLEWVASISDGGSNTYYSDIIKGRFTISRDNAKNSLYLQMNSLKAEDTAVYYCARGFPLLRHGAFDYWGQGTLVTVSSGGGGSGGGGSGGGGSDIQMTQSPSSLSASVGDRVTITCRASQNVDTNVAWYQQKPGQAPKSLIYSATYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 350 - DNA, 1494 bp, artificial
  PM07F8L3-VH-VL x I2C VH-VL
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggcctccatctccgacggcggctccaacacctactactccgacatcatcaagggccggttcaccatctcccgggacaacgccaagaacagcctgtacctgcagatgaactccctgaaggccgaggacaccgccgtgtactactgcgcccggggcttccctctgctgagacacggcgccttcgattactggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcagggcctcccagaacgtggacaccaacgtggcctggtatcagcagaagcccggccaggcccctaagtccctgatctactccgccacctaccggtactctgacgtgccttcccggttctccggctccgcgtccggcaccgacttcaccctgaccatctccagcgtgcagtctgaggacttcgccacgtactactgccagcagtacgactcctacccttacaccttcggcggagggaccaagctggaaatcaagtccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 351 - protein, 121 aa, artificial
  PM07F8H3-VH
QVQLVESGGGLVKPGESLRLSCAASGFTFSDYYMYWVRQAPGKGLEWVASISDGGSNTYYSDIIKGRFTISRDNAKNSLYLQMNSLKAEDTAVYYCARGFPLLRHGAMDYWGQGTLVTVSS

SEQ ID NO: 352 - protein, 5 aa, artificial
  PM07F8H3-HCDR1
DYYMY

SEQ ID NO: 353 - protein, 17 aa, artificial
  PM07F8H3-HCDR2
SISDGGSNTYYSDIIKG

SEQ ID NO: 354 - protein, 12 aa, artificial
  PM07F8H3-HCDR3
GFPLLRHGAMDY

SEQ ID NO: 355 - DNA, 363 bp, artificial
  PM07F8H3-VH
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggcctccatctccgacggcggctccaacacctactactccgacatcatcaagggccggttcaccatctcccgggacaacgccaagaacagcctgtacctgcagatgaactccctgaaggccgaggacaccgccgtgtactactgcgcccggggcttccctctgctgagacacggcgccatggattactggggccagggcaccctggtcaccgtctcctca

SEQ ID NO: 356 - protein, 107 aa, artificial; identical to SEQ ID NO: 300
  PM07F8H3-VL

SEQ ID NO: 357 - protein, 11 aa, artificial
  PM07F8H3-LCDR1
RASQNVDTNVA

SEQ ID NO: 358 - protein, 7 aa, artificial
  PM07F8H3-LCDR1
SATYRYS

SEQ ID NO: 359 - protein, 9 aa, artificial
  PM07F8H3-LCDR1
QQYNSYPYT

SEQ ID NO: 360 - DNA, 321 bp, artificial; identical to SEQ ID NO: 304
  PM07F8H3-VL

SEQ ID NO: 361 - protein, 243 aa, artificial
  PM07F8H3-VH-VL
QVQLVESGGGLVKPGESLRLSCAASGFTFSDYYMYWVRQAPGKGLEWVASISDGGSNTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCRASQNVDTNVAWYQQKPGQAPKSLIYSATYRYSDVPSRFSGSASGTDFTLTISSVQSEDFATYYCQQYNSYPYTFGGGTKLEIK

SEQ ID NO: 362 - DNA, 729 bp, artificial
  PM07F8H3-VH-VL
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggcctccatctccgacggcggctccaacacctactactccgacatcatcaagggccggttcaccatctcccgggacaacgccaagaacagcctgtacctgcagatgaactccctgaaggccgaggacaccgccgtgtactactgcgcccggggcttccctctgctgagacacggcgccatggattactggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcagggcctcccagaacgtggacaccaacgtggcctggtatcagcagaagcccggccaggcccctaagtccctgatctactccgccacctaccggtactctgacgtgccttcccggttctccggctccgcgtccggcaccgacttcaccctgaccatctccagcgtgcagtctgaggacttcgccacgtactactgccagcagtacaactcctacccttacaccttcggcggagggaccaagctggaaatcaag

SEQ ID NO: 363 - protein, 498 aa, artificial
  PM07F8H3-VH-VL x I2C VH-VL
QVQLVESGGGLVKPGESLRLSCAASGFTFSDYYMYWVRQAPGKGLEWVASISDGGSNTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCRASQNVDTNVAWYQQKPGQAPKSLIYSATYRYSDVPSRFSGSASGTDFTLTISSVQSEDFATYYCQQYNSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 364 - DNA, 1493 bp, artificial
  PM07F8H3-VH-VL x I2C VH-VL
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggcctccatctccgacggcggctccaacacctactactccgacatcatcaagggccggttcaccatctcccgggacaacgccaagaacagcctgtacctgcagatgaactccctgaaggccgaggacaccgccgtgtactactgcgcccggggcttccctctgctgagacacggcgccatggattactggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcagggcctcccagaacgtggacaccaacgtggcctggtatcagcagaagcccggccaggcccctaagtccctgatctactccgccacctaccggtactctgacgtgccttcccggttctccggctccgcgtccggcaccgacttcaccctgaccatctccagcgtgcagtctgaggacttcgccacgtactactgccagcagtacaactcctacccttacaccttcggcggagggaccaagctggaaatcaagtccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtcct

SEQ ID NO: 365 - protein, 121 aa, artificial
  PM07F8H2-VH
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAFDYWGQGTLVTVSS

SEQ ID NO: 366 - protein, 5 aa, artificial
  PM07F8H2-HCDR1
DYYMY

SEQ ID NO: 367 - protein, 17 aa, artificial
  PM07F8H2-HCDR2
IISDGGYYTYYSDIIKG

SEQ ID NO: 368 - protein, 12 aa, artificial
  PM07F8H2-HCDR3
GFPLLRHGAFDY

SEQ ID NO: 369 - DNA, 363 bp, artificial
  PM07F8H2-VH
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggccatcatctccgacggcggctactacacctactactccgacatcatcaagggccggttcaccatctcccgggacaacgccaagaacagcctgtacctgcagatgaactccctgaaggccgaggacaccgccgtgtactactgcgcccggggcttccctctgctgagacacggcgccttcgattactggggccagggcaccctggtcaccgtctcctca

SEQ ID NO: 370 - protein, 107 aa, artificial; identical to SEQ ID NO: 300
  PM07F8H2-VL

SEQ ID NO: 371 - protein, 11 aa, artificial
  PM07F8H2-LCDR1
RASQNVDTNVA

SEQ ID NO: 372 - protein, 7 aa, artificial
  PM07F8H2-LCDR2
SATYRYS

SEQ ID NO: 373 - protein, 9 aa, artificial
  PM07F8H2-LCDR3
QQYNSYPYT

SEQ ID NO: 374 - DNA, 321 bp, artificial; identical to SEQ ID NO: 304
  PM07F8H2-VL

SEQ ID NO: 375 - protein, 243 aa, artificial
  PM07F8H2-VH-VL
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAFDYWGQGTLVTVSSGGGGSGGGGSGGGGSDIQMTQSPSSLSASVGDRVTITCRASQNVDTNVAWYQQKPGQAPKSLIYSATYRYSDVPSRFSGSASGTDFTLTISSVQSEDFATYYCQQYNSYPYTFGGGTKLEIK

SEQ ID NO: 376 - DNA, 729 bp, artificial
  PM07F8H2-VH-VL
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggccatcatctccgacggcggctactacacctactactccgacatcatcaagggccggttcaccatctcccgggacaacgccaagaacagcctgtacctgcagatgaactccctgaaggccgaggacaccgccgtgtactactgcgcccggggcttccctctgctgagacacggcgccttcgattactggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcagggcctcccagaacgtggacaccaacgtggcctggtatcagcagaagcccggccaggcccctaagtccctgatctactccgccacctaccggtactctgacgtgccttcccggttctccggctccgcgtccggcaccgacttcaccctgaccatctccagcgtgcagtctgaggacttcgccacgtactactgccagcagtacaactcctacccttacaccttcggcggagggaccaagctggaaatcaag

SEQ ID NO: 377 - protein, 498 aa, artificial
  PM07F8H2-VH-VL x I2C VH-VL
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAFDYWGQGTLVTVSSGGGGSGGGGSGGGGSDIQMTQSPSSLSASVGDRVTITCRASQNVDTNVAWYQQKPGQAPKSLIYSATYRYSDVPSRFSGSASGTDFTLTISSVQSEDFATYYCQQYNSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 378 - DNA, 1494 bp, artificial
  PM07F8H2-VH-VL x I2C VH-V
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggccatcatctccgacggcggctactacacctactactccgacatcatcaagggccggttcaccatctcccgggacaacgccaagaacagcctgtacctgcagatgaactccctgaaggccgaggacaccgccgtgtactactgcgcccggggcttccctctgctgagacacggcgccttcgattactggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcagggcctcccagaacgtggacaccaacgtggcctggtatcagcagaagcccggccaggcccctaagtccctgatctactccgccacctaccggtactctgacgtgccttcccggttctccggctccgcgtccggcaccgacttcaccctgaccatctccagcgtgcagtctgaggacttcgccacgtactactgccagcagtacaactcctacccttacaccttcggcggagggaccaagctggaaatcaagtccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 379 - protein, 118 aa, artificial
  PMH5A5-VH
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSS

SEQ ID NO: 380 - protein, 5 aa, artificial
  PMH5A5-HCDR1
DTYMD

SEQ ID NO: 381 - protein, 17 aa, artificial
  PMH5A5-HCDR2
RIDPANGDSKYDPKFQG

SEQ ID NO: 382 - protein, 9 aa, artificial
  PMH5A5-HCDR3
GGMIWYFDV

SEQ ID NO: 383 - DNA, 354 bp, artificial
  PMH5A5-VH
caggtgcagctggtccagtctggggcagaggttaagaagccaggggcctcagtcaaggtgtcctgcaaagcttctggctacaactttaaagacacctatatggactgggtgaagcagacgcctgaacagggcctggaatggatgggaaggattgatcctgcgaatggtgatagtaaatatgacccgaaattccagggcagggtcactataacagcagacacatccaccaacacagcctacatggagctcagcagcctgagatctgaggacactgccgtctattattgtgctagaggcgggatgatatggtacttcgatgtctggggccaagggaccacggtcaccgtctcctca

SEQ ID NO: 384 - protein, 108 aa, artificial
  PMH5A5-VL
EIVLTQSPATLSLSPGEKATLSCSASSSISSNYLHWYQQKPGLPPRLLIYRTSNLASGIPDRFSGSGSGTDYTLTISRLEPEDVATYYCQQGSSLPYTFGQGTKLEIK

SEQ ID NO: 385 - protein, 12 aa, artificial
  PMH5A5-LCDR1
SASSSISSNYLH

SEQ ID NO: 386 - protein, 7 aa, artificial
  PMH5A5-LCDR2
RTSNLAS

SEQ ID NO: 387 - protein, 9 aa, artificial
  PMH5A5-LCDR3
QQGSSLPYT

SEQ ID NO: 388 - DNA, 324 bp, artificial
  PMH5A5-VL
gagatcgtgctcacccagtctccagccaccctgtctctatctcccggggagaaggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgattacactctcacaattagcaggctggagcctgaagatgttgccacttactactgccagcagggtagtagtttaccgtacacgttcggacaagggaccaagcttgagatcaaa

SEQ ID NO: 389 - protein, 241 aa, artificial
  PMH5A5-VH-VL
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSSGGGGSGGGGSGGGGSEIVLTQSPATLSLSPGEKATLSCSASSSISSNYLHWYQQKPGLPPRLLIYRTSNLASGIPDRFSGSGSGTDYTLTISRLEPEDVATYYCQQGSSLPYTFGQGTKLEIK

SEQ ID NO: 390 - DNA, 723 bp, artificial
  PMH5A5-VH-VL
caggtgcagctggtccagtctggggcagaggttaagaagccaggggcctcagtcaaggtgtcctgcaaagcttctggctacaactttaaagacacctatatggactgggtgaagcagacgcctgaacagggcctggaatggatgggaaggattgatcctgcgaatggtgatagtaaatatgacccgaaattccagggcagggtcactataacagcagacacatccaccaacacagcctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagaaggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgattacactctcacaattagcaggctggagcctgaagatgttgccacttactactgccagcagggtagtagtttaccgtacacgttcggacaagggaccaagcttgagatcaaa

SEQ ID NO: 391 - protein, 497 aa, artificial
  PMH5A5-VH-VL x I2C VH-VL
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSSGGGGSGGGGSGGGGSEIVLTQSPATLSLSPGEKATLSCSASSSISSNYLHWYQQKPGLPPRLLIYRTSNLASGIPDRFSGSGSGTDYTLTISRLEPEDVATYYCQQGSSLPYTFGQGTKLEIKKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 392 - DNA, 1488 bp, artificial
  PMH5A5-VH-VL x I2C VH-VL
caggtgcagctggtccagtctggggcagaggttaagaagccaggggcctcagtcaaggtgtcctgcaaagcttctggctacaactttaaagacacctatatggactgggtgaagcagacgcctgaacagggcctggaatggatgggaaggattgatcctgcgaatggtgatagtaaatatgacccgaaattccagggcagggtcactataacagcagacacatccaccaacacagcctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagaaggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgattacactctcacaattagcaggctggagcctgaagatgttgccacttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 393 - protein, 118 aa, artificial
  PMH8A5-VH
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSS

SEQ ID NO: 394 - protein, 5 aa, artificial
  PMH8A5-HCDR1
DTYMD

SEQ ID NO: 395 - protein, 17 aa, artificial
  PMH8A5-HCDR2
RIDPANGDSKYDPKFQG

SEQ ID NO: 396 - protein, 9 aa, artificial
  PMH8A5-HCDR3
GGMIWYFDV

SEQ ID NO: 397 - DNA, 354 bp, artificial
  PMH8A5-VH
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctca

SEQ ID NO: 398 - protein, 108 aa, artificial; identical to SEQ ID NO: 384
  PMH8A5-VL

SEQ ID NO: 399 - protein, 12 aa, artificial
  PMH8A5-LCDR1
SASSSISSNYLH

SEQ ID NO: 400 - protein, 7 aa, artificial
  PMH8A5-LCDR2
RTSNLAS

SEQ ID NO: 401 - protein, 9 aa, artificial
  PMH8A5-LCDR3
QQGSSLPYT

SEQ ID NO: 402 - DNA, 324 bp, artificial; identical to SEQ ID NO: 388
  PMH8A5-VL

SEQ ID NO: 403 - protein, 241 aa, artificial
  PMH8A5-VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATLSLSPGEKATLSCSASSSISSNYLHWYQQKPGLPPRLLIYRTSNLASGIPDRFSGSGSGTDYTLTISRLEPEDVATYYCQQGSSLPYTFGQGTKLEIK

SEQ ID NO: 404 - DNA, 723 bp, artificial
  PMH8A5-VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagaaggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgattacactctcacaattagcaggctggagcctgaagatgttgccacttactactgccagcagggtagtagtttaccgtacacgttcggacaagggaccaagcttgagatcaaa

SEQ ID NO: 405 - protein, 497 aa, artificial
  PMH8A5-VH-VL x I2C VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATLSLSPGEKATLSCSASSSISSNYLHWYQQKPGLPPRLLIYRTSNLASGIPDRFSGSGSGTDYTLTISRLEPEDVATYYCQQGSSLPYTFGQGTKLEIKKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 406 - DNA, 1487 bp, artificial
  PMH8A5-VH-VL x I2C VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagaaggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgattacactctcacaattagcaggctggagcctgaagatgttgccacttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtcct

SEQ ID NO: 407 - protein, 118 aa, artificial; identical to SEQ ID NO: 379
  PMH5B1-VH

SEQ ID NO: 408 - protein, 5 aa, artificial
  PMH5B1-HCDR1
DTYMD

SEQ ID NO: 409 - protein, 17 aa, artificial
  PMH5B1-HCDR2
RIDPANGDSKYDPKFQG

SEQ ID NO: 410 - protein, 9 aa, artificial
  PMH5B1-HCDR3
GGMIWYFDV

SEQ ID NO: 411 - DNA, 354 bp, artificial; identical to SEQ ID NO: 383
  PMH5B1-VH

SEQ ID NO: 412 - protein, 108 aa, artificial
  PMH5B1-VL
EIVLTQSPATLSLSPGERATLSCSASSSISSNYLHWYQQKPGLPPRLLIYRTSNLASGIPDRFSGSGSGTDFTLTISRMEAEDFAVYYCQQGSSLPYTFGQGTKLEIK

SEQ ID NO: 413 - protein, 12 aa, artificial
  PMH5B1-LCDR1
SASSSISSNYLH

SEQ ID NO: 414 - protein, 7 aa, artificial
  PMH5B1-LCDR2
RTSNLAS

SEQ ID NO: 415 - protein, 9 aa, artificial
  PMH5B1-LCDR3
QQGSSLPYT

SEQ ID NO: 416 - DNA, 324 bp, artificial
  PMH5B1-VL
gagatcgtgctcacccagtctccagccaccctgtctctatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggatggaggctgaagattttgccgtttactactgccagcagggtagtagtttaccgtacacgttcggacaagggaccaagcttgagatcaaa

SEQ ID NO: 417 - protein, 241 aa, artificial
  PMH5B1-VH-VL
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSSGGGGSGGGGSGGGGSEIVLTQSPATLSLSPGERATLSCSASSSISSNYLHWYQQKPGLPPRLLIYRTSNLASGIPDRFSGSGSGTDFTLTISRMEAEDFAVYYCQQGSSLPYTFGQGTKLEIK

SEQ ID NO: 418 - DNA, 723 bp, artificial
  PMH5B1-VH-VL
caggtgcagctggtccagtctggggcagaggttaagaagccaggggcctcagtcaaggtgtcctgcaaagcttctggctacaactttaaagacacctatatggactgggtgaagcagacgcctgaacagggcctggaatggatgggaaggattgatcctgcgaatggtgatagtaaatatgacccgaaattccagggcagggtcactataacagcagacacatccaccaacacagcctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggatggaggctgaagattttgccgtttactactgccagcagggtagtagtttaccgtacacgttcggacaagggaccaagcttgagatcaaa

SEQ ID NO: 419 - protein, 496 aa, artificial
  PMH5B1-VL x I2C VH-VL
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSSGGGGSGGGGSGGGGSEIVLTQSPATLSLSPGERATLSCSASSSISSNYLHWYQQKPGLPPRLLIYRTSNLASGIPDRFSGSGSGTDFTLTISRMEAEDFAVYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 420 - DNA, 1487 bp, artificial
  PMH5B1-VL x I2C VH-VL
caggtgcagctggtccagtctggggcagaggttaagaagccaggggcctcagtcaaggtgtcctgcaaagcttctggctacaactttaaagacacctatatggactgggtgaagcagacgcctgaacagggcctggaatggatgggaaggattgatcctgcgaatggtgatagtaaatatgacccgaaattccagggcagggtcactataacagcagacacatccaccaacacagcctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggatggaggctgaagattttgccgtttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtcct

SEQ ID NO: 421 - protein, 118 aa, artificial; identical to SEQ ID NO: 393
  PMH8B1-VH

SEQ ID NO: 422 - protein, 5 aa, artificial
  PMH8B1-HCDR1
DTYMD

SEQ ID NO: 423 - protein, 17 aa, artificial
  PMH8B1-HCDR2
RIDPANGDSKYDPKFQG

SEQ ID NO: 424 - protein, 9 aa, artificial
  PMH8B1-HCDR3
GGMIWYFDV

SEQ ID NO: 425 - DNA, 354 bp, artificial; identical to SEQ ID NO: 397
  PMH8B1-VH

SEQ ID NO: 426 - protein, 108 aa, artificial; identical to SEQ ID NO: 412
  PMH8B1-VL

SEQ ID NO: 427 - protein, 12 aa, artificial
  PMH8B1-LCDR1
SASSSISSNYLH

SEQ ID NO: 428 - protein, 7 aa, artificial
  PMH8B1-LCDR2
RTSNLAS

SEQ ID NO: 429 - protein, 9 aa, artificial
  PMH8B1-LCDR3
QQGSSLPYT

SEQ ID NO: 430 - DNA, 324 bp, artificial; identical to SEQ ID NO: 416
  PMH8B1-VL

SEQ ID NO: 431 - protein, 241 aa, artificial
  PMH8B1-VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATLSLSPGERATLSCSASSSISSNYLHWYQQKPGLPPRLLIYRTSNLASGIPDRFSGSGSGTDFTLTISRMEAEDFAVYYCQQGSSLPYTFGQGTKLEIK

SEQ ID NO: 432 - DNA, 723 bp, artificial
  PMH8B1-VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggatggaggctgaagattttgccgtttactactgccagcagggtagtagtttaccgtacacgttcggacaagggaccaagcttgagatcaaa

SEQ ID NO: 433 - protein, 496 aa, artificial
  PMH8B1-VH-VL x I2C VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATLSLSPGERATLSCSASSSISSNYLHWYQQKPGLPPRLLIYRTSNLASGIPDRFSGSGSGTDFTLTISRMEAEDFAVYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 434 - DNA, 1487 bp, artificial
  PMH8B1-VH-VL x I2C VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggatggaggctgaagattttgccgtttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtcct

SEQ ID NO: 435 - protein, 118 aa, artificial; identical to SEQ ID NO: 379
  PMH5B45-VH

SEQ ID NO: 436 - protein, 5 aa, artificial
  PMH5B45-HCDR1
DTYMD

SEQ ID NO: 437 - protein, 17 aa, artificial
  PMH5B45-HCDR2
RIDPANGDSKYDPKFQG

SEQ ID NO: 438 - protein, 9 aa, artificial
  PMH5B45-HCDR3
GGMIWYFDV

SEQ ID NO: 439 - DNA, 354 bp, artificial; identical to SEQ ID NO: 383
  PMH5B45-VH

SEQ ID NO: 440 - protein, 108 aa, artificial
  PMH5B45-VL
EIVLTQSPTTLALSPGERVTLSCSASSSISSNYLHWYQQKPGLPPRLLIYRTSNLASGIPDRFSGSGSGTDFTLTISRLEPEDVAVYYCQQGSSLPYTFGQGTKLEIK

SEQ ID NO: 441 - protein, 12 aa, artificial
  PMH5B45-LCDR1
SASSSISSNYLH

SEQ ID NO: 442 - protein, 7 aa, artificial
  PMH5B45-LCDR2
RTSNLAS

SEQ ID NO: 443 - protein, 9 aa, artificial
  PMH5B45-LCDR3
QQGSSLPYT

SEQ ID NO: 444 - DNA, 324 bp, artificial
  PMH5B45-VL
gagatcgtgctcacccagtctccaaccaccctggctctatctcccggggagagggtcactctctcctgcagtgccagctctagtataagttccaattacttgcattggtatcagcagaagccaggattgccccctagactcttgatttataggacatccaatctggcttctggaatcccagatcgcttcagtggcagtgggtctgggaccgatttcactctcacaattagcaggctggagcctgaagatgttgccgtttactactgccagcagggtagtagtttaccgtacacgttcggacaagggaccaagcttgagatcaaa

SEQ ID NO: 445 - protein, 241 aa, artificial
  PMH5B45-VH-VL
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSSGGGGSGGGGSGGGGSEIVLTQSPTTLALSPGERVTLSCSASSSISSNYLHWYQQKPGLPPRLLIYRTSNLASGIPDRFSGSGSGTDFTLTISRLEPEDVAVYYCQQGSSLPYTFGQGTKLEIK

SEQ ID NO: 446 - protein, 723 aa, artificial
  PMH5B45-VH-VL
CAGGTGCAGCTGGTCCAGTCTGGGGCAGAGGTTAAGAAGCCAGGGGCCTCAGTCAAGGTGTCCTGCAAAGCTTCTGGCTACAACTTTAAAGACACCTATATGGACTGGGTGAAGCAGACGCCTGAACAGGGCCTGGAATGGATGGGAAGGATTGATCCTGCGAATGGTGATAGTAAATATGACCCGAAATTCCAGGGCAGGGTCACTATAACAGCAGACACATCCACCAACACAGCCTACATGGAGCTCAGCAGCCTGAGATCTGAGGACACTGCCGTCTATTATTGTGCTAGAGGCGGGATGATATGGTACTTCGATGTCTGGGGCCAAGGGACCACGGTCACCGTCTCCTCAGGTGGTGGTGGTTCTGGCGGCGGCGGCTCCGGTGGTGGTGGTTCTGAGATCGTGCTCACCCAGTCTCCAACCACCCTGGCTCTATCTCCCGGGGAGAGGGTCACTCTCTCCTGCAGTGCCAGCTCTAGTATAAGTTCCAATTACTTGCATTGGTATCAGCAGAAGCCAGGATTGCCCCCTAGACTCTTGATTTATAGGACATCCAATCTGGCTTCTGGAATCCCAGATCGCTTCAGTGGCAGTGGGTCTGGGACCGATTTCACTCTCACAATTAGCAGGCTGGAGCCTGAAGATGTTGCCGTTTACTACTGCCAGCAGGGTAGTAGTTTACCGTACACGTTCGGACAAGGGACCAAGCTTGAGATCAAA

SEQ ID NO: 447 - protein, 496 aa, artificial
  PMH5B45-VH-VL x I2C VH-VL
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSSGGGGSGGGGSGGGGSEIVLTQSPTTLALSPGERVTLSCSASSSISSNYLHWYQQKPGLPPRLLIYRTSNLASGIPDRFSGSGSGTDFTLTISRLEPEDVAVYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 448 - DNA, 1488 bp, artificial
  PMH5B45-VH-VL x I2C VH-VL
caggtgcagctggtccagtctggggcagaggttaagaagccaggggcctcagtcaaggtgtcctgcaaagcttctggctacaactttaaagacacctatatggactgggtgaagcagacgcctgaacagggcctggaatggatgggaaggattgatcctgcgaatggtgatagtaaatatgacccgaaattccagggcagggtcactataacagcagacacatccaccaacacagcctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccaaccaccctggctctatctcccggggagagggtcactctctcctgcagtgccagctctagtataagttccaattacttgcattggtatcagcagaagccaggattgccccctagactcttgatttataggacatccaatctggcttctggaatcccagatcgcttcagtggcagtgggtctgggaccgatttcactctcacaattagcaggctggagcctgaagatgttgccgtttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 449 - protein, 118 aa, artificial; identical to SEQ ID NO: 393
  PMH8B4-VH

SEQ ID NO: 450 - protein, 5 aa, artificial
  PMH8B4-HCDR1
DTYMD

SEQ ID NO: 451 - protein, 17 aa, artificial
  PMH8B4-HCDR2
RIDPANGDSKYDPKFQG

SEQ ID NO: 452 - protein, 9 aa, artificial
  PMH8B4-HCDR3
GGMIWYFDV

SEQ ID NO: 453 - DNA, 354 bp, artificial; identical to SEQ ID NO: 397
  PMH8B4-VH

SEQ ID NO: 454 - protein, 108 aa, artificial; identical to SEQ ID NO: 440
  PMH8B4-VL

SEQ ID NO: 455 - protein, 12 aa, artificial
  PMH8B4-LCDR1
SASSSISSNYLH

SEQ ID NO: 456 - protein, 7 aa, artificial
  PMH8B4-LCDR2
RTSNLAS

SEQ ID NO: 457 - protein, 9 aa, artificial
  PMH8B4-LCDR3
QQGSSLPYT

SEQ ID NO: 458 - DNA, 324 bp, artificial; identical to SEQ ID NO: 444
  PMH8B4-VL

SEQ ID NO: 459 - protein, 241 aa, artificial
  PMH8B4-VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPTTLALSPGERVTLSCSASSSISSNYLHWYQQKPGLPPRLLIYRTSNLASGIPDRFSGSGSGTDFTLTISRLEPEDVAVYYCQQGSSLPYTFGQGTKLEIK

SEQ ID NO: 460 - DNA, 723 bp, artificial
  PMH8B4-VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccaaccaccctggctctatctcccggggagagggtcactctctcctgcagtgccagctctagtataagttccaattacttgcattggtatcagcagaagccaggattgccccctagactcttgatttataggacatccaatctggcttctggaatcccagatcgcttcagtggcagtgggtctgggaccgatttcactctcacaattagcaggctggagcctgaagatgttgccgtttactactgccagcagggtagtagtttaccgtacacgttcggacaagggaccaagcttgagatcaaa

SEQ ID NO: 461 - protein, 496 aa, artificial
  PMH8B4-VH-VL x I2C VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPTTLALSPGERVTLSCSASSSISSNYLHWYQQKPGLPPRLLIYRTSNLASGIPDRFSGSGSGTDFTLTISRLEPEDVAVYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 462 - DNA, 1488 bp, artificial
  PMH8B4-VH-VL x I2C VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccaaccaccctggctctatctcccggggagagggtcactctctcctgcagtgccagctctagtataagttccaattacttgcattggtatcagcagaagccaggattgccccctagactcttgatttataggacatccaatctggcttctggaatcccagatcgcttcagtggcagtgggtctgggaccgatttcactctcacaattagcaggctggagcctgaagatgttgccgtttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 463 - protein, 118 aa, artificial; identical to SEQ ID NO: 379
  PMH5C2-VH

SEQ ID NO: 464 - protein, 5 aa, artificial
  PMH5C2-HCDR1
DTYMD

SEQ ID NO: 465 - protein, 17 aa, artificial
  PMH5C2-HCDR2
RIDPANGDSKYDPKFQG

SEQ ID NO: 466 - protein, 9 aa, artificial
  PMH5C2-HCDR3
GGMIWYFDV

SEQ ID NO: 467 - DNA, 354 bp, artificial; identical to SEQ ID NO: 383
  PMH5C2-VH

SEQ ID NO: 468 - protein, 108 aa, artificial
  PMH5C2-VL
EIVLTQSPATLSVSPGERATLSCSASSSISSNYLHWYQQKPGLSPRLLIYRTSNLASGIPARFSGSGSGTAFTLTISRLEPEDFAVYYCQQGSSLPYTFGQGTKLEIK

SEQ ID NO: 469 - protein, 12 aa, artificial
  PMH5C2-LCDR1
SASSSISSNYLH

SEQ ID NO: 470 - protein, 7 aa, artificial
  PMH5C2-LCDR2
RTSNLAS

SEQ ID NO: 471 - protein, 9 aa, artificial
  PMH5C2-LCDR3
QQGSSLPYT

SEQ ID NO: 472 - DNA, 324 bp, artificial
  PMH5C2-VL
gagatcgtgctcacccagtctccagccaccctgtctgtatctcccggggagagggccactctctcctgcagtgccagctcaagtataagttccaattacttgcattggtatcagcagaagccaggattatcccctagactcttgatttataggacatccaatctggcttctggaatcccagctcgcttcagtggcagtgggtctgggaccgctttcactctcacaattagcaggctggagcctgaagattttgccgtttactactgccagcagggtagtagtttaccgtacacgttcggacaagggaccaagcttgagatcaaa

SEQ ID NO: 473 - protein, 241 aa, artificial
  PMH5C2-VH-VL
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSSGGGGSGGGGSGGGGSEIVLTQSPATLSVSPGERATLSCSASSSISSNYLHWYQQKPGLSPRLLIYRTSNLASGIPARFSGSGSGTAFTLTISRLEPEDFAVYYCQQGSSLPYTFGQGTKLEIK

SEQ ID NO: 474 - DNA, 723 bp, artificial
  PMH5C2-VH-VL
caggtgcagctggtccagtctggggcagaggttaagaagccaggggcctcagtcaaggtgtcctgcaaagcttctggctacaactttaaagacacctatatggactgggtgaagcagacgcctgaacagggcctggaatggatgggaaggattgatcctgcgaatggtgatagtaaatatgacccgaaattccagggcagggtcactataacagcagacacatccaccaacacagcctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctgtatctcccggggagagggccactctctcctgcagtgccagctcaagtataagttccaattacttgcattggtatcagcagaagccaggattatcccctagactcttgatttataggacatccaatctggcttctggaatcccagctcgcttcagtggcagtgggtctgggaccgctttcactctcacaattagcaggctggagcctgaagattttgccgtttactactgccagcagggtagtagtttaccgtacacgttcggacaagggaccaagcttgagatcaaa

SEQ ID NO: 475 - protein, 496 aa, artificial
  PMH5C2-VH-VL x I2C VH-VL
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSSGGGGSGGGGSGGGGSEIVLTQSPATLSVSPGERATLSCSASSSISSNYLHWYQQKPGLSPRLLIYRTSNLASGIPARFSGSGSGTAFTLTISRLEPEDFAVYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 476 - DNA, 1488 bp, artificial
  PMH5C2-VH-VL x I2C VH-VL
caggtgcagctggtccagtctggggcagaggttaagaagccaggggcctcagtcaaggtgtcctgcaaagcttctggctacaactttaaagacacctatatggactgggtgaagcagacgcctgaacagggcctggaatggatgggaaggattgatcctgcgaatggtgatagtaaatatgacccgaaattccagggcagggtcactataacagcagacacatccaccaacacagcctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctgtatctcccggggagagggccactctctcctgcagtgccagctcaagtataagttccaattacttgcattggtatcagcagaagccaggattatcccctagactcttgatttataggacatccaatctggcttctggaatcccagctcgcttcagtggcagtgggtctgggaccgctttcactctcacaattagcaggctggagcctgaagattttgccgtttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 477 - protein, 118 aa, artificial; identical to SEQ ID NO: 393
  PMH8C2-VH

SEQ ID NO: 478 - protein, 5 aa, artificial
  PMH8C2-HCDR1
DTYMD

SEQ ID NO: 479 - protein, 17 aa, artificial
  PMH8C2-HCDR2
RIDPANGDSKYDPKFQG

SEQ ID NO: 480 - protein, 9 aa, artificial
  PMH8C2-HCDR3
GGMIWYFDV

SEQ ID NO: 481 - DNA, 354 bp, artificial; identical to SEQ ID NO: 397
  PMH8C2-VH

SEQ ID NO: 482 - protein, 108 aa, artificial; identical to SEQ ID NO: 468
  PMH8C2-VL

SEQ ID NO: 483 - protein, 12 aa, artificial
  PMH8C2-LCDR1
SASSSISSNYLH

SEQ ID NO: 484 - protein, 7 aa, artificial
  PMH8C2-LCDR2
RTSNLAS

SEQ ID NO: 485 - protein, 9 aa, artificial
  PMH8C2-LCDR3
QQGSSLPYT

SEQ ID NO: 486 - DNA, 324 bp, artificial; identical to SEQ ID NO: 472
  PMH8C2-VL

SEQ ID NO: 487 - protein, 241 aa, artificial
  PMH8C2-VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATLSVSPGERATLSCSASSSISSNYLHWYQQKPGLSPRLLIYRTSNLASGIPARFSGSGSGTAFTLTISRLEPEDFAVYYCQQGSSLPYTFGQGTKLEIK

SEQ ID NO: 488 - DNA, 723 bp, artificial
  PMH8C2-VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctgtatctcccggggagagggccactctctcctgcagtgccagctcaagtataagttccaattacttgcattggtatcagcagaagccaggattatcccctagactcttgatttataggacatccaatctggcttctggaatcccagctcgcttcagtggcagtgggtctgggaccgctttcactctcacaattagcaggctggagcctgaagattttgccgtttactactgccagcagggtagtagtttaccgtacacgttcggacaagggaccaagcttgagatcaaa

SEQ ID NO: 489 - protein, 496 aa, artificial
  PMH8C2-VH-VL x I2C VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATLSVSPGERATLSCSASSSISSNYLHWYQQKPGLSPRLLIYRTSNLASGIPARFSGSGSGTAFTLTISRLEPEDFAVYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 490 - DNA, 1488 bp, artificial
  PMH8C2-VH-VL x I2C VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctgtatctcccggggagagggccactctctcctgcagtgccagctcaagtataagttccaattacttgcattggtatcagcagaagccaggattatcccctagactcttgatttataggacatccaatctggcttctggaatcccagctcgcttcagtggcagtgggtctgggaccgctttcactctcacaattagcaggctggagcctgaagattttgccgtttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 491 - protein, 118 aa, artificial; identical to SEQ ID NO: 379
  PMH5D1-VH

SEQ ID NO: 492 - protein, 5 aa, artificial
  PMH5D1-HCDR1
DTYMD

SEQ ID NO: 493 - protein, 17 aa, artificial
  PMH5D1-HCDR2
RIDPANGDSKYDPKFQG

SEQ ID NO: 494 - protein, 9 aa, artificial
  PMH5D1-HCDR3
GGMIWYFDV

SEQ ID NO: 495 - DNA, 354 bp, artificial; identical to SEQ ID NO: 383
  PMH5D1-VH

SEQ ID NO: 496 - protein, 108 aa, artificial
  PMH5D1-VL
EIVLTQSPATLSLSPGERATLSCSASSSISSNYLHWYQQKPGLPPRLLIYRTSNLASGIPARFSGSGSGTDFTLTISRLEPEDVAVYYCQQGSSLPYTFGQGTKLEIK

SEQ ID NO: 497 - protein, 12 aa, artificial
  PMH5D1-LCDR1
SASSSISSNYLH

SEQ ID NO: 498 - protein, 7 aa, artificial
  PMH5D1-LCDR2
RTSNLAS

SEQ ID NO: 499 - protein, 9 aa, artificial
  PMH5D1-LCDR3
QQGSSLPYT

SEQ ID NO: 500 - DNA, 324 bp, artificial
  PMH5D1-VL
gagatcgtgctcacccagtctccagccaccctgtctctatctcccggggagagggccactctctcctgcagtgccagctcaagtataagttccaattacttgcattggtatcagcagaagccaggattaccccctagactcttgatttataggacatccaatctggcttctggaatcccagctcgcttcagtggcagtgggtctgggaccgatttcactctcacaattagcaggctggagcctgaagatgttgccgtttactactgccagcagggtagtagtttaccgtacacgttcggacaagggaccaagcttgagatcaaa

SEQ ID NO: 501 - protein, 241 aa, artificial
  PMH5D1-VH-VL
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSSGGGGSGGGGSGGGGSEIVLTQSPATLSLSPGERATLSCSASSSISSNYLHWYQQKPGLPPRLLIYRTSNLASGIPARFSGSGSGTDFTLTISRLEPEDVAVYYCQQGSSLPYTFGQGTKLEIK

SEQ ID NO: 502 - DNA, 723 bp, artificial
  PMH5D1-VH-VL
caggtgcagctggtccagtctggggcagaggttaagaagccaggggcctcagtcaaggtgtcctgcaaagcttctggctacaactttaaagacacctatatggactgggtgaagcagacgcctgaacagggcctggaatggatgggaaggattgatcctgcgaatggtgatagtaaatatgacccgaaattccagggcagggtcactataacagcagacacatccaccaacacagcctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagagggccactctctcctgcagtgccagctcaagtataagttccaattacttgcattggtatcagcagaagccaggattaccccctagactcttgatttataggacatccaatctggcttctggaatcccagctcgcttcagtggcagtgggtctgggaccgatttcactctcacaattagcaggctggagcctgaagatgttgccgtttactactgccagcagggtagtagtttaccgtacacgttcggacaagggaccaagcttgagatcaaa

SEQ ID NO: 503 - protein, 496 aa, artificial
  PMH5D1-VH-VL x I2C VH-VL
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSSGGGGSGGGGSGGGGSEIVLTQSPATLSLSPGERATLSCSASSSISSNYLHWYQQKPGLPPRLLIYRTSNLASGIPARFSGSGSGTDFTLTISRLEPEDVAVYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 504 - DNA, 1488 bp, artificial
  PMH5D1-VH-VL x I2C VH-VL
caggtgcagctggtccagtctggggcagaggttaagaagccaggggcctcagtcaaggtgtcctgcaaagcttctggctacaactttaaagacacctatatggactgggtgaagcagacgcctgaacagggcctggaatggatgggaaggattgatcctgcgaatggtgatagtaaatatgacccgaaattccagggcagggtcactataacagcagacacatccaccaacacagcctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagagggccactctctcctgcagtgccagctcaagtataagttccaattacttgcattggtatcagcagaagccaggattaccccctagactcttgatttataggacatccaatctggcttctggaatcccagctcgcttcagtggcagtgggtctgggaccgatttcactctcacaattagcaggctggagcctgaagatgttgccgtttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 505 - protein, 118 aa, artificial; identical to SEQ ID NO: 393
  PMH8D1-VH

SEQ ID NO: 506 - protein, 5 aa, artificial
  PMH8D1-HCDR1
DTYMD

SEQ ID NO: 507 - protein, 17 aa, artificial
  PMH8D1-HCDR2
RIDPANGDSKYDPKFQG

SEQ ID NO: 508 - protein, 9 aa, artificial
  PMH8D1-HCDR3
GGMIWYFDV

SEQ ID NO: 509 - DNA, 354 bp, artificial; identical to SEQ ID NO: 397
  PMH8D1-VH

SEQ ID NO: 510 - protein, 108 aa, artificial; identical to SEQ ID NO: 496
  PMH8D1-VL

SEQ ID NO: 511 - protein, 12 aa, artificial
  PMH8D1-LCDR1
SASSSISSNYLH

SEQ ID NO: 512 - protein, 7 aa, artificial
  PMH8D1-LCDR2
RTSNLAS

SEQ ID NO: 513 - protein, 9 aa, artificial
  PMH8D1-LCDR3
QQGSSLPYT

SEQ ID NO: 514 - DNA, 324 bp, artificial; identical to SEQ ID NO: 500
  PMH8D1-VL

SEQ ID NO: 515 - protein, 241 aa, artificial
  PMH8D1-VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATLSLSPGERATLSCSASSSISSNYLHWYQQKPGLPPRLLIYRTSNLASGIPARFSGSGSGTDFTLTISRLEPEDVAVYYCQQGSSLPYTFGQGTKLEIK

SEQ ID NO: 516 - DNA, 723 bp, artificial
  PMH8D1-VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagagggccactctctcctgcagtgccagctcaagtataagttccaattacttgcattggtatcagcagaagccaggattaccccctagactcttgatttataggacatccaatctggcttctggaatcccagctcgcttcagtggcagtgggtctgggaccgatttcactctcacaattagcaggctggagcctgaagatgttgccgtttactactgccagcagggtagtagtttaccgtacacgttcggacaagggaccaagcttgagatcaaa

SEQ ID NO: 517 - protein, 496 aa, artificial
  PMH8D1-VH-VL x I2C VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATLSLSPGERATLSCSASSSISSNYLHWYQQKPGLPPRLLIYRTSNLASGIPARFSGSGSGTDFTLTISRLEPEDVAVYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 518 - DNA, 1488 bp, artificial
  PMH8D1-VH-VL x I2C VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagagggccactctctcctgcagtgccagctcaagtataagttccaattacttgcattggtatcagcagaagccaggattaccccctagactcttgatttataggacatccaatctggcttctggaatcccagctcgcttcagtggcagtgggtctgggaccgatttcactctcacaattagcaggctggagcctgaagatgttgccgtttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 519 - protein, 118 aa, artificial; identical to SEQ ID NO: 379
  PMH5E2-VH

SEQ ID NO: 520 - protein, 5 aa, artificial
  PMH5E2-HCDR1
DTYMD

SEQ ID NO: 521 - protein, 17 aa, artificial
  PMH5E2-HCDR2
RIDPANGDSKYDPKFQG

SEQ ID NO: 522 - protein, 9 aa, artificial
  PMH5E2-HCDR3
GGMIWYFDV

SEQ ID NO: 523 - DNA, 354 bp, artificial; identical to SEQ ID NO: 383
  PMH5E2-VH

SEQ ID NO: 524 - protein, 108 aa, artificial
  PMH5E2-VL
EIVLTQSPATMSVSPGERATLSCSASSSISSNYLHWYQQKPGLPPRLLIYRTSNLASGIPDRFSGSGSGTDFTLTISRLEAEDFATYYCQQGSSLPYTFGQGTKLEIK

SEQ ID NO: 525 - protein, 12 aa, artificial
  PMH5E2-LCDR1
SASSSISSNYLH

SEQ ID NO: 526 - protein, 7 aa, artificial
  PMH5E2-LCDR2
RTSNLAS

SEQ ID NO: 527 - protein, 9 aa, artificial
  PMH5E2-LCDR3
QQGSSLPYT

SEQ ID NO: 528 - DNA, 324 bp, artificial
  PMH5E2-VL
gagatcgtgctcacccagtctccagccaccatgtctgtatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggctggaggctgaagattttgccacttactactgccagcagggtagtagtttaccgtacacgttcggacaagggaccaagcttgagatcaaa

SEQ ID NO: 529 - protein, 241 aa, artificial
  PMH5E2-VH-VL
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSSGGGGSGGGGSGGGGSEIVLTQSPATMSVSPGERATLSCSASSSISSNYLHWYQQKPGLPPRLLIYRTSNLASGIPDRFSGSGSGTDFTLTISRLEAEDFATYYCQQGSSLPYTFGQGTKLEIK

SEQ ID NO: 530 - DNA, 723 bp, artificial
  PMH5E2-VH-VL
caggtgcagctggtccagtctggggcagaggttaagaagccaggggcctcagtcaaggtgtcctgcaaagcttctggctacaactttaaagacacctatatggactgggtgaagcagacgcctgaacagggcctggaatggatgggaaggattgatcctgcgaatggtgatagtaaatatgacccgaaattccagggcagggtcactataacagcagacacatccaccaacacagcctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccatgtctgtatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggctggaggctgaagattttgccacttactactgccagcagggtagtagtttaccgtacacgttcggacaagggaccaagcttgagatcaaa

SEQ ID NO: 531 - protein, 496 aa, artificial
  PMH5E2-VH-VL c I2C VH-VL
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSSGGGGSGGGGSGGGGSEIVLTQSPATMSVSPGERATLSCSASSSISSNYLHWYQQKPGLPPRLLIYRTSNLASGIPDRFSGSGSGTDFTLTISRLEAEDFATYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 532 - DNA, 1488 bp, artificial
  PMH5E2-VH-VL c I2C VH-VL
caggtgcagctggtccagtctggggcagaggttaagaagccaggggcctcagtcaaggtgtcctgcaaagcttctggctacaactttaaagacacctatatggactgggtgaagcagacgcctgaacagggcctggaatggatgggaaggattgatcctgcgaatggtgatagtaaatatgacccgaaattccagggcagggtcactataacagcagacacatccaccaacacagcctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccatgtctgtatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggctggaggctgaagattttgccacttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 533 - protein, 118 aa, artificial; identical to SEQ ID NO: 393
  PMH8E2-VH

SEQ ID NO: 534 - protein, 5 aa, artificial
  PMH8E2-HCDR1
DTYMD

SEQ ID NO: 535 - protein, 17 aa, artificial
  PMH8E2-HCDR2
RIDPANGDSKYDPKFQG

SEQ ID NO: 536 - protein, 9 aa, artificial
  PMH8E2-HCDR3
GGMIWYFDV

SEQ ID NO: 537 - DNA, 354 bp, artificial; identical to SEQ ID NO: 397
  PMH8E2-VH

SEQ ID NO: 538 - protein, 108 aa, artificial; identical to SEQ ID NO: 524
  PMH8E2-VL

SEQ ID NO: 539 - protein, 12 aa, artificial
  PMH8E2-LCDR1
SASSSISSNYLH

SEQ ID NO: 540 - protein, 7 aa, artificial
  PMH8E2-LCDR2
RTSNLAS

SEQ ID NO: 541 - protein, 9 aa, artificial
  PMH8E2-LCDR3
QQGSSLPYT

SEQ ID NO: 542 - DNA, 324 bp, artificial; identical to SEQ ID NO: 528
  PMH8E2-VL

SEQ ID NO: 543 - protein, 241 aa, artificial
  PMH8E2-VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATMSVSPGERATLSCSASSSISSNYLHWYQQKPGLPPRLLIYRTSNLASGIPDRFSGSGSGTDFTLTISRLEAEDFATYYCQQGSSLPYTFGQGTKLEIK

SEQ ID NO: 544 - DNA, 723 bp, artificial
  PMH8E2-VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccatgtctgtatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggctggaggctgaagattttgccacttactactgccagcagggtagtagtttaccgtacacgttcggacaagggaccaagcttgagatcaaa

SEQ ID NO: 545 - protein, 496 aa, artificial
  PMH8E2-VH-VL x I2C VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATMSVSPGERATLSCSASSSISSNYLHWYQQKPGLPPRLLIYRTSNLASGIPDRFSGSGSGTDFTLTISRLEAEDFATYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 546 - DNA, 1488 bp, artificial
  PMH8E2-VH-VL x I2C VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccatgtctgtatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggctggaggctgaagattttgccacttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 547 - protein, 118 aa, artificial; identical to SEQ ID NO: 393
  PMH8E4-VH

SEQ ID NO: 548 - protein, 5 aa, artificial
  PMH8E4-HCDR1
DTYMD

SEQ ID NO: 549 - protein, 17 aa, artificial
  PMH8E4-HCDR2
RIDPANGDSKYDPKFQG

SEQ ID NO: 550 - protein, 9 aa, artificial
  PMH8E4-HCDR3
GGMIWYFDV

SEQ ID NO: 551 - DNA, 354 bp, artificial; identical to SEQ ID NO: 397
  PMH8E4-VH

SEQ ID NO: 552 - protein, 108 aa, artificial
  PMH8E4-VL
EIVLTQSPATLSLSPGERATLSCSASSSISSNYLHWYQQKPGLPPRLLIYRTSNLASGIPDRFSGSGSGTDYTLTISRLEPEDFATYYCQQGSSLPYTFGQGTKLEIK

SEQ ID NO: 553 - protein, 12 aa, artificial
  PMH8E4-LCDR1
SASSSISSNYLH

SEQ ID NO: 554 - protein, 7 aa, artificial
  PMH8E4-LCDR2
RTSNLAS

SEQ ID NO: 555 - protein, 9 aa, artificial
  PMH8E4-LCDR3
QQGSSLPYT

SEQ ID NO: 556 - DNA, 324 bp, artificial
  PMH8E4-VL
gagatcgtgctcacccagtctccagccaccctgtctctatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgattacactctcacaattagcaggctggagcctgaagattttgccacttactactgccagcagggtagtagtttaccgtacacgttcggacaagggaccaagcttgagatcaaa

SEQ ID NO: 557 - protein, 241 aa, artificial
  PMH8E4-VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATLSLSPGERATLSCSASSSISSNYLHWYQQKPGLPPRLLIYRTSNLASGIPDRFSGSGSGTDYTLTISRLEPEDFATYYCQQGSSLPYTFGQGTKLEIK

SEQ ID NO: 558 - DNA, 723 bp, artificial
  PMH8E4-VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgattacactctcacaattagcaggctggagcctgaagattttgccacttactactgccagcagggtagtagtttaccgtacacgttcggacaagggaccaagcttgagatcaaa

SEQ ID NO: 559 - protein, 496 aa, artificial
  PMH8E4-VH-VL x I2C VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATLSLSPGERATLSCSASSSISSNYLHWYQQKPGLPPRLLIYRTSNLASGIPDRFSGSGSGTDYTLTISRLEPEDFATYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 560 - DNA, 1488 bp, artificial
  PMH8E4-VH-VL x I2C VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgattacactctcacaattagcaggctggagcctgaagattttgccacttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 561 - protein, 118 aa, artificial; identical to SEQ ID NO: 393
  PMH8G6-VH

SEQ ID NO: 562 - protein, 5 aa, artificial
  PMH8G6-HCDR1
DTYMD

SEQ ID NO: 563 - protein, 17 aa, artificial
  PMH8G6-HCDR2
RIDPANGDSKYDPKFQG

SEQ ID NO: 564 - protein, 9 aa, artificial
  PMH8G6-HCDR3
GGMIWYFDV

SEQ ID NO: 565 - DNA, 354 bp, artificial; identical to SEQ ID NO: 397
  PMH8G6-VH

SEQ ID NO: 566 - protein, 108 aa, artificial
  PMH8G6-VL
EIVLTQSPATMSLSPGERATISCSASSSISSNYLHWYQQKPGLPPKLLIYRTSNLASGIPDRFSGSGSGTDFTLTISRMEPEDFAVYYCQQGSSLPYTFGQGTKLEIK

SEQ ID NO: 567 - protein, 12 aa, artificial
  PMH8G6-LCDR1
SASSSISSNYLH

SEQ ID NO: 568 - protein, 7 aa, artificial
  PMH8G6-LCDR2
RTSNLAS

SEQ ID NO: 569 - protein, 9 aa, artificial
  PMH8G6-LCDR3
QQGSSLPYT

SEQ ID NO: 570 - DNA, 324 bp, artificial
  PMH8G6-VL
gagatcgtgctcacccagtctccagccaccatgtctctatctcccggggagagggccactatctcctgcagtgccagctcaagtataagttccaattacttgcattggtatcagcagaagccaggattgccccctaaactcttgatttataggacatccaatctggcttctggaatcccagatcgcttcagtggcagtgggtctgggaccgatttcactctcacaattagcaggatggagcctgaagattttgccgtttactactgccagcagggtagtagtttaccgtacacgttcggacaagggaccaagcttgagatcaaa

SEQ ID NO: 571 - protein, 241 aa, artificial
  PMH8G6-VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATMSLSPGERATISCSASSSISSNYLHWYQQKPGLPPKLLIYRTSNLASGIPDRFSGSGSGTDFTLTISRMEPEDFAVYYCQQGSSLPYTFGQGTKLEIK

SEQ ID NO: 572 - DNA, 723 bp, artificial
  PMH8G6-VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccatgtctctatctcccggggagagggccactatctcctgcagtgccagctcaagtataagttccaattacttgcattggtatcagcagaagccaggattgccccctaaactcttgatttataggacatccaatctggcttctggaatcccagatcgcttcagtggcagtgggtctgggaccgatttcactctcacaattagcaggatggagcctgaagattttgccgtttactactgccagcagggtagtagtttaccgtacacgttcggacaagggaccaagcttgagatcaaa

SEQ ID NO: 573 - protein, 496 aa, artificial
  PMH8G6-VH-VL x I2C VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATMSLSPGERATISCSASSSISSNYLHWYQQKPGLPPKLLIYRTSNLASGIPDRFSGSGSGTDFTLTISRMEPEDFAVYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 574 - DNA, 1488 bp, artificial
  PMH8G6-VH-VL x I2C VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccatgtctctatctcccggggagagggccactatctcctgcagtgccagctcaagtataagttccaattacttgcattggtatcagcagaagccaggattgccccctaaactcttgatttataggacatccaatctggcttctggaatcccagatcgcttcagtggcagtgggtctgggaccgatttcactctcacaattagcaggatggagcctgaagattttgccgtttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 575 - protein, 118 aa, artificial; identical to SEQ ID NO: 379
  PMH5H2-VH

SEQ ID NO: 576 - protein, 5 aa, artificial
  PMH5H2-HCDR1
DTYMD

SEQ ID NO: 577 - protein, 17 aa, artificial
  PMH5H2-HCDR2
RIDPANGDSKYDPKFQG

SEQ ID NO: 578 - protein, 9 aa, artificial
  PMH5H2-HCDR3
GGMIWYFDV

SEQ ID NO: 579 - DNA, 354 bp, artificial; identical to SEQ ID NO: 383
  PMH5H2-VH

SEQ ID NO: 580 - protein, 108 aa, artificial
  PMH5H2-VL
EIVLTQSPATMALSPGERATLSCSASSSISSNYLHWYQQKPGLPPRLLIYRTSNLASGIPDRFSGSGSGTDFTLTISRLEPEDVAVYYCQQGSSLPYTFGQGTKLEIK

SEQ ID NO: 581 - protein, 12 aa, artificial
  PMH5H2-LCDR1
SASSSISSNYLH

SEQ ID NO: 582 - protein, 7 aa, artificial
  PMH5H2-LCDR2
RTSNLAS

SEQ ID NO: 583 - protein, 9 aa, artificial
  PMH5H2-LCDR3
QQGSSLPYT

SEQ ID NO: 584 - DNA, 324 bp, artificial
  PMH5H2-VL
gagatcgtgctcacccagtctccagccaccatggctctatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggctggagcctgaagatgttgccgtttactactgccagcagggtagtagtttaccgtacacgttcggacaagggaccaagcttgagatcaaa

SEQ ID NO: 585 - protein, 241 aa, artificial
  PMH5H2-VH-VL
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSSGGGGSGGGGSGGGGSEIVLTQSPATMALSPGERATLSCSASSSISSNYLHWYQQKPGLPPRLLIYRTSNLASGIPDRFSGSGSGTDFTLTISRLEPEDVAVYYCQQGSSLPYTFGQGTKLEIK

SEQ ID NO: 586 - DNA, 723 bp, artificial
  PMH5H2-VH-VL
caggtgcagctggtccagtctggggcagaggttaagaagccaggggcctcagtcaaggtgtcctgcaaagcttctggctacaactttaaagacacctatatggactgggtgaagcagacgcctgaacagggcctggaatggatgggaaggattgatcctgcgaatggtgatagtaaatatgacccgaaattccagggcagggtcactataacagcagacacatccaccaacacagcctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccatggctctatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggctggagcctgaagatgttgccgtttactactgccagcagggtagtagtttaccgtacacgttcggacaagggaccaagcttgagatcaaa

SEQ ID NO: 587 - protein, 496 aa, artificial
  PMH5H2-VH-VL x I2C VH-VL
QVQLVQSGAEVKKPGASVKVSCKASGYNFKDTYMDWVKQTPEQGLEWMGRIDPANGDSKYDPKFQGRVTITADTSTNTAYMELSSLRSEDTAVYYCARGGMIWYFDVWGQGTTVTVSSGGGGSGGGGSGGGGSEIVLTQSPATMALSPGERATLSCSASSSISSNYLHWYQQKPGLPPRLLIYRTSNLASGIPDRFSGSGSGTDFTLTISRLEPEDVAVYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 588 - DNA, 1488 bp, artificial
  PMH5H2-VH-VL x I2C VH-VL
caggtgcagctggtccagtctggggcagaggttaagaagccaggggcctcagtcaaggtgtcctgcaaagcttctggctacaactttaaagacacctatatggactgggtgaagcagacgcctgaacagggcctggaatggatgggaaggattgatcctgcgaatggtgatagtaaatatgacccgaaattccagggcagggtcactataacagcagacacatccaccaacacagcctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccatggctctatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggctggagcctgaagatgttgccgtttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 589 - protein, 118 aa, artificial; identical to SEQ ID NO: 393
  PMH8H2-VH

SEQ ID NO: 590 - protein, 5 aa, artificial
  PMH8H2-HCDR1
DTYMD

SEQ ID NO: 591 - protein, 17 aa, artificial
  PMH8H2-HCDR2
RIDPANGDSKYDPKFQG

SEQ ID NO: 592 - protein, 9 aa, artificial
  PMH8H2-HCDR3
GGMIWYFDV

SEQ ID NO: 593 - DNA, 354 bp, artificial; identical to SEQ ID NO: 397
  PMH8H2-VH

SEQ ID NO: 594 - protein, 108 aa, artificial; identical to SEQ ID NO: 580
  PMH8H2-VL

SEQ ID NO: 595 - protein, 12 aa, artificial
  PMH8H2-LCDR1
SASSSISSNYLH

SEQ ID NO: 596 - protein, 7 aa, artificial
  PMH8H2-LCDR2
RTSNLAS

SEQ ID NO: 597 - protein, 9 aa, artificial
  PMH8H2-LCDR3
QQGSSLPYT

SEQ ID NO: 598 - DNA, 324 bp, artificial; identical to SEQ ID NO: 584
  PMH8H2-VL

SEQ ID NO: 599 - protein, 241 aa, artificial
  PMH8H2-VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATMALSPGERATLSCSASSSISSNYLHWYQQKPGLPPRLLIYRTSNLASGIPDRFSGSGSGTDFTLTISRLEPEDVAVYYCQQGSSLPYTFGQGTKLEIK

SEQ ID NO: 600 - DNA, 723 bp, artificial
  PMH8H2-VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccatggctctatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggctggagcctgaagatgttgccgtttactactgccagcagggtagtagtttaccgtacacgttcggacaagggaccaagcttgagatcaaa

SEQ ID NO: 601 - protein, 496 aa, artificial
  PMH8H2-VH-VL x I2C VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATMALSPGERATLSCSASSSISSNYLHWYQQKPGLPPRLLIYRTSNLASGIPDRFSGSGSGTDFTLTISRLEPEDVAVYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 602 - DNA, 1488 bp, artificial
  PMH8H2-VH-VL x I2C VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccatggctctatctcccggggagagggccactctctcctgcagtgccagctcaagtataagttccaattacttgcattggtatcagcagaagccaggattgccccctagactcttgatttataggacatccaatctggcttctggaatcccagatcgcttcagtggcagtgggtctgggaccgatttcactctcacaattagcaggctggagcctgaagatgttgccgtttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 603 - protein, 118 aa, artificial; identical to SEQ ID NO: 393
  PMH8H3-VH

SEQ ID NO: 604 - protein, 5 aa, artificial
  PMH8H3-HCDR1
DTYMD

SEQ ID NO: 605 - protein, 17 aa, artificial
  PMH8H3-HCDR2
RIDPANGDSKYDPKFQG

SEQ ID NO: 606 - protein, 9 aa, artificial
  PMH8H3-HCDR3
GGMIWYFDV

SEQ ID NO: 607 - DNA, 354 bp, artificial; identical to SEQ ID NO: 397
  PMH8H3-VH

SEQ ID NO: 608 - protein, 108 aa, artificial
  PMH8H3-VL
EIVLTQSPATLSLSPGERITLSCSASSSISSNYLHWYQQKPGLPPRLLIYRTSNLASGIPDRFSGSGSGTDFTLTIGTLEPEDFAVYYCQQGSSLPYTFGQGTKLEIK

SEQ ID NO: 609 - protein, 12 aa, artificial
  PMH8H3-LCDR1
SASSSISSNYLH

SEQ ID NO: 610 - protein, 7 aa, artificial
  PMH8H3-LCDR2
RTSNLAS

SEQ ID NO: 611 - protein, 9 aa, artificial
  PMH8H3-LCDR3
QQGSSLPYT

SEQ ID NO: 612 - DNA, 324 bp, artificial
  PMH8H3-VL
gagatcgtgctcacccagtctccagccaccctgtctctatctcccggggagaggatcactctctcctgcagtgccagctcaagtataagttccaattacttgcattggtatcagcagaagccaggattaccccctagactcttgatttataggacatccaatctggcttctggaatcccagatcgcttcagtggcagtgggtctgggaccgatttcactctcacaattggcacgctggagcctgaagattttgccgtttactactgccagcagggtagtagtttaccgtacacgttcggacaagggaccaagcttgagatcaaa

SEQ ID NO: 613 - protein, 241 aa, artificial
  PMH8H3-VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATLSLSPGERITLSCSASSSISSNYLHWYQQKPGLPPRLLIYRTSNLASGIPDRFSGSGSGTDFTLTIGTLEPEDFAVYYCQQGSSLPYTFGQGTKLEIK

SEQ ID NO: 614 - DNA, 723 bp, artificial
  PMH8H3-VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagaggatcactctctcctgcagtgccagctcaagtataagttccaattacttgcattggtatcagcagaagccaggattaccccctagactcttgatttataggacatccaatctggcttctggaatcccagatcgcttcagtggcagtgggtctgggaccgatttcactctcacaattggcacgctggagcctgaagattttgccgtttactactgccagcagggtagtagtttaccgtacacgttcggacaagggaccaagcttgagatcaaa

SEQ ID NO: 615 - protein, 496 aa, artificial
  PMH8H3-VH-VL x I2C VH-VL
QVQLVQSGAEVVKPGASVKLSCKASGFTITDTYMDWVRQAPGQGLEWIGRIDPANGDSKYDPKFQGRATITPDTSTNTVYMELSSLRSEDTAVYYCARGGMIWYFDVWGQGTTVTVSSGGGGSGGGGSGGGGSEIVLTQSPATLSLSPGERITLSCSASSSISSNYLHWYQQKPGLPPRLLIYRTSNLASGIPDRFSGSGSGTDFTLTIGTLEPEDFAVYYCQQGSSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 616 - DNA, 1488 bp, artificial
  PMH8H3-VH-VL x I2C VH-VL
caggtgcagctggtccagtctggggcagaggttgtgaagccaggggcctcagtcaagttgtcctgcaaagcttctggcttcaccattacagacacctatatggactgggtgaggcaggcgcctggacagggcctggaatggattggaaggattgatcctgcgaatggtgatagtaaatatgacccgaaattccagggcagggccactataacaccagacacatccaccaacacagtctacatggagctcagcagcctgagatctgaggacactgccgtctattattgtgctagaggcgggatgatatggtacttcgatgtctggggccaagggaccacggtcaccgtctcctcaggtggtggtggttctggcggcggcggctccggtggtggtggttctgagatcgtgctcacccagtctccagccaccctgtctctatctcccggggagaggatcactctctcctgcagtgccagctcaagtataagttccaattacttgcattggtatcagcagaagccaggattaccccctagactcttgatttataggacatccaatctggcttctggaatcccagatcgcttcagtggcagtgggtctgggaccgatttcactctcacaattggcacgctggagcctgaagattttgccgtttactactgccagcagggtagtagtttaccgtacacgttcggacaagggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 617 - protein, 120 aa, artificial
  PM74G3-VH
QVQLVQSGAEVKKPGASVKLSCKASGYTFTYFDINWVRQAPEQGLEWMGGISPGDGNTNYNENFKGRVTMTIDTSSSTAYIELSRLTSDDTAVYYCARDGNFPYYAMDSWGQGTTVTVSS

SEQ ID NO: 618 - protein, 5 aa, artificial
  PM74G3-HCDR1
YFDIN

SEQ ID NO: 619 - protein, 17 aa, artificial
  PM74G3-HCDR2
GISPGDGNTNYNENFKG

SEQ ID NO: 620 - protein, 11 aa, artificial
  PM74G3-HCDR3
DGNFPYYAMDS

SEQ ID NO: 621 - DNA, 360 bp, artificial
  PM74G3-VH
caggtgcagctggtccagtctggcgccgaagtgaagaagcctggcgcctccgtgaagctgtcctgcaaggcctccggctacaccttcacctacttcgacatcaactgggtgcggcaggcgcctgagcagggcctggaatggatgggcggcatctcccctggcgacggcaacaccaactacaacgagaacttcaagggcagggtcacaatgaccatagacacgtccagctccaccgcctacatcgagctgtcccggctgacatctgacgacaccgccgtgtactactgcgccagggacggcaacttcccttactacgccatggactcttggggccagggcaccacggtgaccgtctcctca

SEQ ID NO: 622 - protein, 112 aa, artificial
  PM74G3-VL
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 623 - protein, 16 aa, artificial
  PM74G3-LCDR1
RSSQSLVHSNGNTYLH

SEQ ID NO: 624 - protein, 7 aa, artificial
  PM74G3-LCDR2
KVSNRFS

SEQ ID NO: 625 - protein, 9 aa, artificial
  PM74G3-LCDR3
SQSTHVPYT

SEQ ID NO: 626 - DNA, 336 bp, artificial
  PM74G3-VL
gacgtcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 627 - protein, 247 aa, artificial
  PM74G3-VH-VL
QVQLVQSGAEVKKPGASVKLSCKASGYTFTYFDINWVRQAPEQGLEWMGGISPGDGNTNYNENFKGRVTMTIDTSSSTAYIELSRLTSDDTAVYYCARDGNFPYYAMDSWGQGTTVTVSSGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 628 - DNA, 741 bp, artificial
  PM74G3-VH-VL
caggtgcagctggtccagtctggcgccgaagtgaagaagcctggcgcctccgtgaagctgtcctgcaaggcctccggctacaccttcacctacttcgacatcaactgggtgcggcaggcgcctgagcagggcctggaatggatgggcggcatctcccctggcgacggcaacaccaactacaacgagaacttcaagggcagggtcacaatgaccatagacacgtccagctccaccgcctacatcgagctgtcccggctgacatctgacgacaccgccgtgtactactgcgccagggacggcaacttcccttactacgccatggactcttggggccagggcaccacggtgaccgtctcctcaggtggtggtggttctggcggcggcggctccggtggtggtggttctgacgtcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 629 - protein, 502 aa, artificial
  PM74G3-VH-VL x I2C VH-VL
QVQLVQSGAEVKKPGASVKLSCKASGYTFTYFDINWVRQAPEQGLEWMGGISPGDGNTNYNENFKGRVTMTIDTSSSTAYIELSRLTSDDTAVYYCARDGNFPYYAMDSWGQGTTVTVSSGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 630 - DNA, 1506 bp, artificial
  PM74G3-VH-VL x I2C VH-VL
caggtgcagctggtccagtctggcgccgaagtgaagaagcctggcgcctccgtgaagctgtcctgcaaggcctccggctacaccttcacctacttcgacatcaactgggtgcggcaggcgcctgagcagggcctggaatggatgggcggcatctcccctggcgacggcaacaccaactacaacgagaacttcaagggcagggtcacaatgaccatagacacgtccagctccaccgcctacatcgagctgtcccggctgacatctgacgacaccgccgtgtactactgcgccagggacggcaacttcccttactacgccatggactcttggggccagggcaccacggtgaccgtctcctcaggtggtggtggttctggcggcggcggctccggtggtggtggttctgacgtcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 631 - protein, 27 aa, Macaca fascicularis
QDGNEEMGSITQTPYQVSISGTTILTC

SEQ ID NO: 632 - protein, 27 aa, Macaca fascicularis
QDGNEEMGSITQTPYQVSISGTTVILT

SEQ ID NO: 633 - protein, 27 aa, Macaca mulatta
QDGNEEMGSITQTPYHVSISGTTVILT

SEQ ID NO: 634 - protein, 5 aa, artificial
  Epitope
QDGNE

The invention claimed is:

1. A bispecific single chain antibody molecule comprising a first binding domain which is an antigen-interaction site, capable of binding to an epitope of human and *Callithrix jacchus, Saguinis oedipus* or *Saimiri sciureus* CD3 epsilon (CD3ε) chain, wherein the epitope is part of an amino acid sequence comprised in the group consisting of SEQ ID NOS: 2, 4, 6, or 8, and comprises at least the amino acid sequence Gln-Asp-Gly-Asn-Glu (QDGNE) (SEQ ID NO: 634), and a second binding domain capable of binding to human and/or non-Chimpanzee primate prostate-specific membrane antigen (PSMA), and comprises the following sequences as CDR H1, CDR H2, CDR H3, CDR L1, CDR L2 and CDR L3 in the second binding domain selected from:
 a) CDR H1-3 of SEQ ID NOs: 226-228 and CDR L1-3 of SEQ ID SEQ ID NOs: 231-233;
 b) CDR H1-3 of SEQ ID SEQ ID NOs: 254-256 and CDR L1-3 of SEQ ID SEQ ID NOs: 259-261;
 c) CDR H1-3 of SEQ ID SEQ ID NOs: 268-270 and CDR L1-3 of SEQ ID SEQ ID NOs: 273-275;
 d) CDR H1-3 of SEQ ID NOs: 618-620 and CDR L1-3 of SEQ ID NOs: 623-625;
 e) CDR H1-3 of SEQ ID NOs: 282-284 and CDR L1-3 of SEQ ID NOs: 287-289;
 f) CDR H1-3 of SEQ ID NOs: 296-298 and CDR L1-3 of SEQ ID NOs: 301-303;
 g) CDR H1-3 of SEQ ID NOs: 310-312 and CDR L1-3 of SEQ ID NOs: 315-317;
 h) CDR H1-3 of SEQ ID NOs: 324-326 and CDR L1-3 of SEQ ID NOs: 329-331;
 i) CDR H1-3 of SEQ ID NOs: 338-340 and CDR L1-3 of SEQ ID NOs: 343-345;
 j) CDR H1-3 of SEQ ID NOs: 352-354 and CDR L1-3 of SEQ ID NOs: 357-359; and
 k) CDR H1-3 of SEQ ID NOs: 366-368 and CDR L1-3 of SEQ ID NOs: 371-373.

2. The bispecific single chain antibody molecule of claim 1, wherein the epitope is part of an amino acid sequence comprised in the group consisting of SEQ ID NOs: 2, 4, 6 and 8 and comprises at least the amino acid sequence Gln-Asp-Gly-Asn-Glu (QDGNE) (SEQ ID NO: 634).

3. The bispecific single chain antibody molecule of claim 1, wherein at least one of said first or second binding domain is CDR-grafted or humanized.

4. The bispecific single chain antibody molecule of claim 1, wherein the first binding domain capable of binding to an epitope of human and non-chimpanzee primate CD3ε chain comprises CDR H1, CDR H2, CDR H3, CDR L1, CDR L2 and CDR L3 selected from:
 (a) CDR H1 as depicted in SEQ ID NO: 12, CDR H2 as depicted in SEQ ID NO: 13, CDR H3 as depicted in SEQ ID NO: 14, CDR L1 as depicted in SEQ ID NO: 27, CDR L2 as depicted in SEQ ID NO: 28 and CDR L3 as depicted in SEQ ID NO: 29;
 (b) CDR H1 as depicted in SEQ ID NO: 30, CDR H2 as depicted in SEQ ID NO: 31, CDR H3 as depicted in SEQ ID NO: 32, CDR L1 as depicted in SEQ ID NO: 27, CDR L2 as depicted in SEQ ID NO: 28 and CDR L3 as depicted in SEQ ID NO: 29;
 (c) CDR H1 as depicted in SEQ ID NO: 48, CDR H2 as depicted in SEQ ID NO: 49, CDR H3 as depicted in SEQ ID NO: 50, CDR L1 as depicted in SEQ ID NO: 27, CDR L2 as depicted in SEQ ID NO: 28 and CDR L3 as depicted in SEQ ID NO: 29;
 (d) CDR H1 as depicted in SEQ ID NO: 66, CDR H2 as depicted in SEQ ID NO: 67, CDR H3 as depicted in SEQ ID NO: 68, CDR L1 as depicted in SEQ ID NO: 27, CDR L2 as depicted in SEQ ID NO: 28 and CDR L3 as depicted in SEQ ID NO: 29;
 (e) CDR H1 as depicted in SEQ ID NO: 84, CDR H2 as depicted in SEQ ID NO: 85, CDR H3 as depicted in SEQ ID NO: 86, CDR L1 as depicted in SEQ ID NO: 117, CDR L2 as depicted in SEQ ID NO: 118 and CDR L3 as depicted in SEQ ID NO: 119;
 (f) CDR H1 as depicted in SEQ ID NO: 102, CDR H2 as depicted in SEQ ID NO: 103, CDR H3 as depicted in SEQ ID NO: 104, CDR L1 as depicted in SEQ ID NO: 27, CDR L2 as depicted in SEQ ID NO: 28 and CDR L3 as depicted in SEQ ID NO: 29;
 (g) CDR H1 as depicted in SEQ ID NO: 120, CDR H2 as depicted in SEQ ID NO: 121, CDR H3 as depicted in SEQ ID NO: 122, CDR L1 as depicted in SEQ ID NO: 117, CDR L2 as depicted in SEQ ID NO: 118 and CDR L3 as depicted in SEQ ID NO: 119;
 (h) CDR H1 as depicted in SEQ ID NO: 138, CDR H2 as depicted in SEQ ID NO: 139, CDR H3 as depicted in SEQ ID NO: 140, CDR L1 as depicted in SEQ ID NO: 27, CDR L2 as depicted in SEQ ID NO: 28 and CDR L3 as depicted in SEQ ID NO: 29;
 (i) CDR H1 as depicted in SEQ ID NO: 156, CDR H2 as depicted in SEQ ID NO: 157, CDR H3 as depicted in SEQ ID NO: 158, CDR L1 as depicted in SEQ ID NO: 153, CDR L2 as depicted in SEQ ID NO: 154 and CDR L3 as depicted in SEQ ID NO: 155; and
 (j) CDR H1 as depicted in SEQ ID NO: 174, CDR H2 as depicted in SEQ ID NO: 175, CDR H3 as depicted in SEQ ID NO: 176, CDR L1 as depicted in SEQ ID NO: 153, CDR L2 as depicted in SEQ ID NO: 154 and CDR L3 as depicted in SEQ ID NO: 155.

5. The bispecific single chain antibody molecule of claim 4, wherein the first binding domain capable of binding to an epitope of human and non-chimpanzee primate CD3ε chain comprises:
 (i) a VL region selected from the group consisting of a VL region as depicted in SEQ ID NO: 35, 39, 125, 129, 161 or 165; and (ii) a VH region selected from the group consisting of a VH region as depicted in SEQ ID NO: 15, 19, 33, 37, 51, 55, 69, 73, 87, 91, 105, 109, 123, 127, 141, 145, 159, 163, 177 or 181.

6. The bispecific single chain antibody molecule of claim 4, wherein the first binding domain capable of binding to an epitope of human and non-chimpanzee primate CD3ε chain comprises a VL region and a VH region selected from the group consisting of:
   (a) a VL region as depicted in SEQ ID NO: 17 or 21 and a VH region as depicted in SEQ ID NO: 15 or 19;
   (b) a VL region as depicted in SEQ ID NO: 35 or 39 and a VH region as depicted in SEQ ID NO: 33 or 37;
   (c) a VL region as depicted in SEQ ID NO: 53 or 57 and a VH region as depicted in SEQ ID NO: 51 or 55;
   (d) a VL region as depicted in SEQ ID NO: 71 or 75 and a VH region as depicted in SEQ ID NO: 69 or 73;
   (e) a VL region as depicted in SEQ ID NO: 89 or 93 and a VH region as depicted in SEQ ID NO: 87 or 91;
   (f) a VL region as depicted in SEQ ID NO: 107 or 111 and a VH region as depicted in SEQ ID NO: 105 or 109;
   (g) a VL region as depicted in SEQ ID NO: 125 or 129 and a VH region as depicted in SEQ ID NO: 123 or 127;
   (h) a VL region as depicted in SEQ ID NO: 143 or 147 and a VH region as depicted in SEQ ID NO: 141 or 145;
   (i) a VL region as depicted in SEQ ID NO: 161 or 165 and a VH region as depicted in SEQ ID NO: 159 or 163; and
   (j) a VL region as depicted in SEQ ID NO: 179 or 183 and a VH region as depicted in SEQ ID NO: 177 or 181.

7. The bispecific single chain antibody molecule according to claim 6, wherein the first binding domain capable of binding to an epitope of human and non-chimpanzee primate CD3ε chain comprises an amino acid sequence selected from the group consisting of SEQ ID NOs: 23, 25, 41, 43, 59, 61, 77, 79, 95, 97, 113, 115, 131, 133, 149, 151, 167, 169, 185, and 187.

8. The bispecific single chain antibody molecule of claim 7, wherein the binding domains are arranged in the order VH PSMA-VL PSMA-VH CD3-VL CD3 or VL PSMA-VH PSMA-VH CD3-VL CD3.

9. The bispecific single chain antibody molecule of claim 8, wherein the bispecific single chain antibody molecule comprises a sequence selected from:
   (a) an amino acid sequence as depicted in SEQ ID NO: 237, 251, 265, 279, 629, 293, 307, 321, 335, 349, 363, 377, 405, 419, 433, 447, 461, 475, 489, 503, 517, 531, 545, 559, 573, 587, 601, or 615; or
   (b) an amino acid sequence encoded by a nucleic acid sequence as depicted in SEQ ID NO: 238, 252, 266, 280, 630, 294, 308, 322, 336, 350, 364, 378, 392, 406, 420, 434, 448, 462, 476, 490, 504, 518, 532, 546, 560, 574, 588, 602 or 616.

10. A nucleic acid sequence encoding the bispecific single chain antibody molecule of any one of claim 1-3, 4, 5, 6, 7, 8 or 9.

11. A vector, which comprises the nucleic acid sequence of claim 10.

12. The vector of claim 11, wherein said vector further comprises a regulatory sequence, which is operably linked to said nucleic acid sequence.

13. The vector of claim 12, wherein said vector is an expression vector.

14. A host cell transformed or transfected with the vector of any one of claims 11 to 13.

15. A process for producing a bispecific single chain antibody molecule, said process comprising culturing the host cell of claim 14 under conditions allowing the expression of the bispecific single chain antibody molecule and recovering the polypeptide from the culture.

16. A pharmaceutical composition comprising the bispecific single chain antibody molecule of claim 1 and a pharmaceutically acceptable carrier, stabilizer, or excipient.

17. The pharmaceutical composition of claim 16 further comprising a drug.

18. The pharmaceutical composition of claim 17, wherein the drug is a non-proteinaceous compound.

19. The pharmaceutical composition of claim 17, wherein the drug is a proteinaceous compound.

20. A method for treating or ameliorating cancer in a subject, said method comprising the step of administering an effective amount of the antibody molecule of claim 1 or the pharmaceutical composition of claim 16.

21. The method of claim 20, wherein said cancer is a solid tumor.

22. The method of claim 20 or 21, wherein said pharmaceutical composition is administered in combination with an additional drug.

23. The method of claim 22, wherein said drug is a non-proteinaceous compound.

24. The method of claim 22, wherein said additional drug is administered non-simultaneously with the pharmaceutical composition.

25. The method of claim 22, wherein said drug is a proteinaceous compound.

26. The method of claim 22, wherein the additional drug is administered simultaneously with the pharmaceutical composition.

27. The method of claim 21, wherein the solid tumor is a carcinoma or prostate cancer.

28. The method of any one of claim 20, 21, 23, 24, 25, 26, or 27, wherein said subject is human.

29. A kit comprising the bispecific single chain antibody molecule of claim 1.

30. A kit comprising the pharmaceutical composition of claim 16.

31. The kit of claim 30 further comprising a drug.

32. The kit of claim 31, wherein the drug is a proteinaceous compound.

33. The kit of claim 32, wherein the drug is a non-proteinaceous compound.

34. The kit of claim 31 further comprising instruction for delivering the pharmaceutical composition and the drug simultaneously or sequentially.

* * * * *